United States Patent 12,569,549 (FLAVIVIRUS VACCINE) - sequence listing, part 12

SEQ ID NO: 6774 - RNA, 9876 nt, synthetic construct
  misc_feature 1..9876: note = derived and/or modified CDS sequence (wt) from DENV-2__EU569716__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcatatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgaccgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggagctaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatccttacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcggacaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaagccaagatgaactgattggtagagctcgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6775 - RNA, 9876 nt, synthetic construct
  misc_feature 1..9876: note = derived and/or modified CDS sequence (wt) from DENV-2__EU569717__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacgcaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgttaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagccagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgcaaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttggttaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaagcaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttctcagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6776 - RNA, 9876 nt, synthetic construct
  misc_feature 1..9876: note = derived and/or modified CDS sequence (wt) from DENV-2__EU569718__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatttgtaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagtacgctgtaggtaatgacacaggaaaacatggcaaggaaattaaaataacaccacagagttccatcacagaagcagaactgacaggctatggcactgttacgatggagtgctctccgagaacgggcctcgacttcaatgaaatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgttgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacgtagaagcagaacctccattcggagacagctacatcatcataggagtagagccgggacaattgaaactcaattggttcaagaagggaagttctattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactatctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggggttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggaaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaactggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaagaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttatggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaagcgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagccgcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaaaggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggccagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaaaaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattctgcataaaggttctcaacccatatatgccctcagtcatagaaaaaatggaaacactacaaaggaaatatggaggagccttggtgaggaatccactctcacgaaactccacacatgagatgtactgggtatccaatgctactgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtcgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6777 - RNA, 9876 nt, synthetic construct
  misc_feature 1..9876: note = derived and/or modified CDS sequence (wt) from DENV-2__EU596488__SS-prME
  source 1..9876: mol_type = other RNA
acagcaggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttagaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaataaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggagtcctgtggtag

SEQ ID NO: 6778 - RNA, 9876 nt, synthetic construct
  misc_feature 1..9876: note = derived and/or modified CDS sequence (wt) from DENV-2__EU596489__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggttttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgattaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggcaatgatacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaactggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggactttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgacactggttgcgttgtgagctggaaaaataaagaactgaaatgtggcagcgggatcttcattacagataacgtgcacacatggacagaacaatacaagttccaaccagaattcccttcaaaactagcttcagctatcaagaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtatgggatggaaatcagaccattgaaagagaaagaggagaatctggtcaactccttggtcacagccggacatgggcagattgataacttttcattaggagttttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctttggacttttcccctggaacgtcaggatctccaattgtcgacagaaaaggaaaagttgtgggtctttacggtaatggtgttgttacaaggagtggagcatacgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcatggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaagttaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagccggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaactttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatacatgccctcagtcatagaaaaaatggaaacactacaaaggaaatatggaggagccttggtgaggaatccactctcacgaaactccacacatgagatgtactgggtatccaatgccaccgggaacatagtgtcatcagtgaacatgatttcaaggatgttgattaacagattcacaatgaaacacaagaaagccacttacgagccagacgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggctatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgtttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6779 - RNA, 9876 nt, synthetic construct
  misc_feature 1..9876: note = derived and/or modified CDS sequence (wt) from DENV-2__EU596490__SS-prME
  source 1..9876: mol_type = other RNA
acagccggcgtgattattatgttgattccaacagtaatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatattgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagatctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacacacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcttatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaactaataccggaaccataggcgccgtgtctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggttatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacgtcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagagatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccagatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6780 - RNA, 9876 nt, synthetic construct
  misc_feature 1..9876: note = derived and/or modified CDS sequence (wt) from DENV-2__EU596491__SS-prME
  source 1..9876: mol_type = other RNA
acagcaggcgtgattattatgttgattccaacagtgatggcgttccatttaaccacacgcaatggagaaccacacatgatcgttggtaggcaggagaaagggaaaagtctcctgttcaaaacagaggatggtgttaacatgtgtaccctcatggccatagaccttggtgaattgtgtgaagacacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatagttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaacttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacaatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacggggcatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagtcaacccaatcgtaacagaaaaagatgccccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctgtggtgcaggcagatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaagggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccgaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggaaaacttggtcaactccttggtcacagccggacatgggcagattgacaacttttcactaggagtcttgggaatggcactgttcctggaagaaatgcttaggacccgagtaggaacgaaacatgcaacactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggccatttcgtgtgtcccaaatgcagtgatattgcaaaacgcatggaaagtgagttgcacaatattggcagcggtgtccgtttctccactgctcctaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacatttcatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgattatcatggacgaagcccacttcacagacccagcaagcatagcagctagaggatacatttcaactcgagtagagatgggtgaagcagcaggtattttcatgacagccactcctccgggaagcagagacccatttcctcagagcaatgcaccaatcatagatgaggagagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccgttgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgcacaatcatgctctcagtgaactgccggagaccctggagacactgcttctactgacactcctggcaacagtcacaggaggaattttcttattcttaatgagcggaaaaggtatagggaagatgactctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttactggtagcacattatgctattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgtgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaatacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaatatggtcacaccggaagggaaggtggtggatcttggttgcggcagagggggctggtcatactattgtgggggactaaagaatgtaagagaagtcaaaggcctaacaaaaggaggaccaggacacgaggaacccatccccatgtcaacatatgggtggaatctagtgcgtctgcaaagtggtgttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagagaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggctagcaagagtggggcgtgaaaggctatcaagaatggccatcagtggagatgactgtgttgtaaaacccatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6781 - RNA, 9876 nt, synthetic construct
  misc_feature 1..9876: note = derived and/or modified CDS sequence (wt) from DENV-2__EU677141__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaagatgtcgttgttttagggtctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagatacgtcttaggtcgcctgattacagttaacccaatcgtaacaggaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggaggacttcttactgtgtgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagatgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaagcccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaaccaggccacagtgctaatgggtcttgggagaggatggccattgtcaaagatggacatcggagttcccctccttgccattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagacagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6782 - RNA, 9876 nt, synthetic construct
  misc_feature 1..9876: note = derived and/or modified CDS sequence (wt) from DENV-2__EU677144__SS-prME
  source 1..9876: mol_type = other RNA
acagcaggcatgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacgacaacagaatctcgttgtccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggattaaattggatacagaaagagacattggtcactttcaaaaatccccacgcgaagaaacaagatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaagagatacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatctctgggaggagtgtttacatctataggaaaggctcttcaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaattgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaaatcacacaccctctggagcaatggagtattagaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacaactactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagactattcttgaactgactgatgcgttagccttgggcatgatggtcctcaaaatagtgagaaatatggaaaagtaccaattggcagtgactatcatggctatcttgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaactactctttcgagaaccagcaagaaaaggagctggccgctaaatgaagctgtcatggcagtcgggatggtgagcattctagccagttctctcctaaagaatgacattcccatgacaggtccattagtggctggaggacttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccaatggaaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggagttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagctatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacgtttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggatttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaaccgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccagttgacctacgtagtcatagccatcctcacagtggtggccgcaaccatggcaaatgagatgggtttcctggaaaaaaccaagaaagacctcggattgggaagcattataacccaggaatctgagagcaacatcctggacatagatctacgtcctgcatcagcatggacgctgtatgccgtggctacaacatttgtcacaccaatgttgagacatagcatcgaaaattcctcagtgaatgtctccctaacagccattgctaatcaggccacagtgctaatgggtcttgggagaggatggccattgtcaaagatggacatcggagttcccctccttgctattggatgctattcacaagtcaaccctataactctcacagcagcccttcttttgctggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgacccaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcacgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtagacacgagaacccaagaaccgaaggaaggcacaaagaaactaatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgcgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacattagaagacttaaaaaatgaggaaatggtaacaaaccacatgaaaggagaacacaagaaactagccgaggccatatttaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacggaactggctagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccctcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcgcattgggttccaacaagtcgaacaacctggtccatacacgctaagcatgaatggatgacgacggaagacatgctggcagtctggaacagggtttggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6783 - RNA, 9876 nt, synthetic construct
  misc_feature 1..9876: note = derived and/or modified CDS sequence (wt) from DENV-2__EU677145__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgatgcataggaatatcaaatagagacttcgtagaaggggtttcaggaggaagctgggttgacatagtcttagaacatggaagttgtgtgacaacgatggcaaaaaacaaaccaacattggattttgaactgataaaaacagaagccaaacaacctgccactctaaggaagtactgtatagaagcaaagctgaccaacacaacaacagaatcgcgttgcccaacacaaggagaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtacagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcactatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgctaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaatcgtgaaagaaatagcagaaacacaacatggaacaatagttatcagagtacaatatgaaggggacggttctccatgtaagatcccttttgagataacagatttggaaaaaagacacgtcttaggacgcctgattacagttaacccaatcataacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcctttagtggggtctcatggactatgaaaatcctcataggggtcatcatcacatggataggaatgaattcacgtagcacctcactgtctgtgtcgctagtattggtgggagtcgtgacactgtacctgggagccatggtgcaggctgatagtggttgcgttgtgagctggaaaaataaagagctgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagagaatgaagtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcgctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaagttttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccatgccagagaccattcttgaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcaacggtgtccgtttctccactgctcttaacatcctcacagcagaaagcggattggataccactggcattgactataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtaaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagactgaccatcatggacctccatccaggagcaggaaagacaaaaagataccttccagccatagttagagaagccataaaacgtggcttgagaacattgatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagcaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacagagtggcagctgaaggcatcaactacgcagacagaaagtggtgttttgatggaattaagaacaaccaaatactggaagaaaacgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatttccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctagcaaaagaaggcatcaaaagaggagaaacggaccaccatgccgtgtcacgaggatcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccgtccctatgtcaacatatgggtggaatctagtgcgtctgcaaagtggggttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacaccactccatttggacaacagcgcgttttcaaagagaaagtggacacgagaactcaagaaccgaaggaaggcacaaagaaactgatgaaaattacagcagagtggctttggaaagaactaggaaagaaaaagacacctaggatgtgtaccagagaagaattcacaaaaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggggaaggaatcttcaaaagcattcagcacctgacagccacagaagaaatcgctgtacagaactggttagcaagagtggggcgtgaaaggctatcaagaatggccatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccatagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6784 - RNA, 9876 nt, synthetic construct
  misc_feature 1..9876: note = derived and/or modified CDS sequence (wt) from DENV-2__EU677146__SS-prME
  source 1..9876: mol_type = other RNA
acagtaggcgtgattgttatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcggtgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggtctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtcaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcattgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggcaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactactagtcgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattacaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcatcttagccagttctctcctaaagaatgacattcctatgacaggtccattagtggctggagggcttcttactgtgtgttacgtgctcactggacgatcggccgatttggaactggagagagctgccgatgtgaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcctactagagttgtggcagctgaaatggaggaagctcttagaggacttccaataagataccaaaccccagccattagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaaccgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacccctggaaaatgatgaagactgtgcacattggaaagaagccaaaatgctcttagataacatcaacacacctgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggccaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattgggattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacccaggatgtgtaccagagaagaatttacaagaaaggtaagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaattgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6785 - RNA, 9876 nt, synthetic construct
  misc_feature 1..9876: note = derived and/or modified CDS sequence (wt) from DENV-2__EU687214__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaaaaacatggaaggaaaagttgtgctgccagaaaatctggaatacaccatcgtgataacgcctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcgtcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgaggaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacgaacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggctacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacgtgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacactcagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacgagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaatagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtctggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6786 - RNA, 9876 nt, synthetic construct
  misc_feature 1..9876: note = derived and/or modified CDS sequence (wt) from DENV-2__EU687215__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcgtcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgatataggtatgggagtgacttaccttgccctactagcagccttcaaagttagaccaacttttgcagctggactactcttgaggaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggtagcatgtcgataaaaaatgaagaggaagaacatacactaaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaaaaccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggctacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacagcatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtggcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacgtgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacactcagagtcctcaacttagtggaaaattggttgaacaataacacccaattttgcgtaaaggttctcaacccatatatgccctcagtcatagagaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttatgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacgagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtctggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6787 - RNA, 9876 nt, synthetic construct
  misc_feature 1..9876: note = derived and/or modified CDS sequence (wt) from DENV-2__EU687216__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacggaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaacggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagagctgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcatcacagataacgtacacacatggacagaacaatataagttccaaccagaatccccttcaaaactagcttcagctatccaaaaagcccatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttaatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggaaaacttggtcaactccttggtcacagccggacatgggcagattgacaacttttcactaggagtcttgggaatggcactgttcctggaagaaatgcttaggacccgagtaggaacgaaacatgcaatactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattagcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacccggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggtttgagaacattaatcctggctcccactagagtcgtggcagctgaaatggaggaagctcttaggggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccacccctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgactgggactttgtggtcacaactgacatttcagaaatgggtgccaacttcaaggctgagagggttatagaccctagacgttgcatgaaaccagttatactaacagatggcgaagagcgagtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggaactaatgagaagaggggacttaccagtctggttggcctacaaagtggcagcagaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgtacaatcatgctctcagtgaactgccggagaccctggagacactgcttctactgacactcctggcaacagtcacaggaggaatcttcttattcttaatgagcggaaaaggtgtagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttatcacaccaatgttgcgacatagcattgaaaattcctcagtaaatgtctccctaacagccattgctaaccaagctacagtgctaatgggtcttgggaaaggatggccattgtcaaagatggacataggagttcccctccttgccattggatgctactcacaagtcaaccctataaccctcacagcagctcttcttctattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccatcatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaaaacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6788 - RNA, 9876 nt, synthetic construct
  misc_feature 1..9876: note = derived and/or modified CDS sequence (wt) from DENV-2__EU726770__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgcagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggcatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagatatcaaaccccagccatcagagccgagcacaccgggcgggagatcgtggacctaatgtgccatgccacatttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcatcacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggaacaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggttatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaagagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6789 - RNA, 9876 nt, synthetic construct
  misc_feature 1..9876: note = derived and/or modified CDS sequence (wt) from DENV-2__EU781135__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattctactgacagccgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacactatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggcagcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgcgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaattgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctatcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaagggaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagcgggcaagtcggcacctatggcctcaatactttcaccaatatggaagcccaattaattagacagatggaaggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagccagaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6790 - RNA, 9876 nt, synthetic construct
  misc_feature 1..9876: note = derived and/or modified CDS sequence (wt) from DENV-2__EU687222__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6791 - RNA, 9876 nt, synthetic construct
  misc_feature 1..9876: note = derived and/or modified CDS sequence (wt) from DENV-2__EU687223__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacaggaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacgtggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagcctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6792 - RNA, 9876 nt, synthetic construct
  misc_feature 1..9876: note = derived and/or modified CDS sequence (wt) from DENV-2__EU687227__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagttgaagtactcatggaaaacatggggaaaggcgaaaatgctctccacagagtctcacaatcagacctttcttattgatggccctgaaacagcagaatgccccaacacaaacagagcctggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacccatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcgaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggctgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatccatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccagatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6793 - RNA, 9876 nt, synthetic construct
  misc_feature 1..9876: note = derived and/or modified CDS sequence (wt) from DENV-2__EU687228__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgcatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaatgaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccctcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatcaaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6794 - RNA, 9876 nt, synthetic construct
  misc_feature 1..9876: note = derived and/or modified CDS sequence (wt) from DENV-2__EU687230__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgcaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtggcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6795 - RNA, 9876 nt, synthetic construct
  misc_feature 1..9876: note = derived and/or modified CDS sequence (wt) from DENV-2__EU687231__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagttttggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtagacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaattcctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagtggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaatataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagagggtggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccagtggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6796 - RNA, 9876 nt, synthetic construct
  misc_feature 1..9876: note = derived and/or modified CDS sequence (wt) from DENV-2__EU687199__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagcttaaaggaatgtcatactctatgtgtacaggaaagtttaaaattgtgaaggaaatagcagaaacacaacatggaacaatagttatcagagtacaatatgaaggggacggctctccatgtaagattccttttgagatgatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctgtcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcgcacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcacgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaacctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccatggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6797 - RNA, 9876 nt, synthetic construct
  misc_feature 1..9876: note = derived and/or modified CDS sequence (wt) from DENV-2__EU687235__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagattctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccactagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6798 - RNA, 9876 nt, synthetic construct
  misc_feature 1..9876: note = derived and/or modified CDS sequence (wt) from DENV-2__EU687236__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgtcttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcaaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagctatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccggaaaaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcctgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctggtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaaaaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggagtcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6799 - RNA, 9876 nt, synthetic construct
  misc_feature 1..9876: note = derived and/or modified CDS sequence (wt) from DENV-2__EU687237__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6800 - RNA, 9876 nt, synthetic construct
  misc_feature 1..9876: note = derived and/or modified CDS sequence (wt) from DENV-2__EU687238__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttaccatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccatcatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtgtctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccatcatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6801 - RNA, 9876 nt, synthetic construct
  misc_feature 1..9876: note = derived and/or modified CDS sequence (wt) from DENV-2__EU687240__SS-prME
  source 1..9876: mol_type = other RNA
acagtaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagttttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagtcaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggcaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgttagtcgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattacaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcatcttagccagttctctcctaaagaatgacattcctatgacaggtccattagtggctggagggcttcttactgtgtgttacgtgctcactggacgatcggccgatttggaactggagagagctgccgatgtgaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcctactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaaccgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcaaaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggccaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccggaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattgggattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgttgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacccaggatgtgtaccagagaagaatttacaagaaaggtaagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaattgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6802 - RNA, 9876 nt, synthetic construct
  misc_feature 1..9876: note = derived and/or modified CDS sequence (wt) from DENV-2__EU687241__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagccttctgttcaaaacagaggatggcgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatactccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgacaaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagtattcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaactatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagacgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctaatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactaccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttctatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcgtcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6803 - RNA, 9876 nt, synthetic construct
  misc_feature 1..9876: note = derived and/or modified CDS sequence (wt) from DENV-2__EU687242__SS-prME
  source 1..9876: mol_type = other RNA
acagcaggcgtgattattatgttgattccaacagcaatggcgttccatttaaccacacgtaatggagaaccacacatgatagttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattagaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgctactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcagaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcggaatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcaatgaactgccggagaccctggagacactgcttttactgacactcctggccacagtcacaggaggaatcttcttattcttaatgagcggaaaaggtatagggaagatgaccctgggaatgtgttgtataatcacggctagcatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaaaaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctaacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagttagatcccttataggcaatgaggaatacacagactacatgccatccatgaaaagattcagaaaggaagaggaagaggcaggtgtcctgtggtag

SEQ ID NO: 6804 - RNA, 9876 nt, synthetic construct
  misc_feature 1..9876: note = derived and/or modified CDS sequence (wt) from DENV-2__EU687243__SS-prME
  source 1..9876: mol_type = other RNA
acagcaggcgtgattattatgttgattccaacagcaatggcgttccatttaaccacacgtaatggagaaccacacatgatagttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattagaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcggaatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttgccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcaatgaactgccggagaccctggagacactgcttttactgacactcctggccacagtcacaggaggaatcttcttattcttaatgagcggaaaaggtatagggaagatgaccctgggaatgtgttgtataatcacggctagcatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaaaaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctaacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6805 - RNA, 9876 nt, synthetic construct
  misc_feature 1..9876: note = derived and/or modified CDS sequence (wt) from DENV-2__EU687245__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggttggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccatttggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtaacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacatttcatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagcatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcaatgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtgatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatgcaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaaaaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccatccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacatcaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgcttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcggtaaatcaagtcagatcccttataggcaatgaggaatacacagactacatgccatccatgaaaagattcagaaaggaagaggaagaggcaggtgtcctgtggtag

SEQ ID NO: 6806 - RNA, 9873 nt, synthetic construct
  misc_feature 1..9873: note = derived and/or modified CDS sequence (wt) from DENV-2__HQ541798__SS-prME
  source 1..9873: mol_type = other RNA
actgcaggcatgatctttatgctgattccaacagtgatggcgttccatttaaccacacgtaacggagaaccacacatgatcgtcagtagacaagagaaagggaaaagtcttctgtttaaaacaggggatggtgtgaacatgtgtaccctcatggccatggaccttggtgaattgtgtgaagatacaatcacgtacaagtgtcctcttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaatctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggattatttggaaaaggaggcattgtgacctgtgctatgttcacatgcaaaaaggacatgaaaggagaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggatggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgcttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctaattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagccacacaccctctggagtaatgaagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgacgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaactaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcactaccaatcacggcagcagcatggtacctgtgggaagtgaagaaacaacgggctggagtattgtgggatgtcccttcacccccacccgtaggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccattttacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagattgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgagcctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccatcgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccttcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaataaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagatacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggtagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactggaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtactcgtagttccatgtagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacagcggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaggttagatcccttataggcaatgaggaatacacagattacatgccatccatgaaaagattcagaagagaagaggaagaggcaggagtcctgtggtag

SEQ ID NO: 6807 - RNA, 9876 nt, synthetic construct
  misc_feature 1..9876: note = derived and/or modified CDS sequence (wt) from DENV-2__JF730053__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacaggggatggtgtgaacatgtgtaccctcatggccatggaccttggtgaattgtgtgaagatacaatcacgtacaagtgtcctcttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaatctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggattatttggaaaaggaggcattgtgacctgtgctatgttcacatgcaaaaagaacatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgcttgagacaacaatgaggggagcgaagagaatggccattttaggtgacacagcttgggattttggatccctgggaggagtgtttacatctataggaaaggctctccaccaagtcttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatgaagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgacgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaactaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcactaccaatcacggcagcagcatggtacctgtgggaagtgaagaaacaacgggctggagtattgtgggatgtcccttcacccccacccgtaggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggtaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagattgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgagcctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccatcgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcctacggtagaagcaggacgaacactcagagtccttaacttagtggaaaattggttgaacaacaacacccaattttgcataaaggttctcaacccatacatgccttcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggtagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagatctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacagcggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6808 - RNA, 9876 nt, synthetic construct
  misc_feature 1..9876: note = derived and/or modified CDS sequence (wt) from DENV-2__EU529706__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgttgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgttcacatgcaaaaagaacatggaaggaaaagtcgtgcagccagaaaatctggaatacaccatcgtgataacacctcactcaggagaagagcacgctgtaggtaatgacacaggaaagcatggcaaggaaatcaaaataacaccacagagctccatcacagaagcagaactgacaggctatggcactgtcacgatggagtgctctccgagaacgggcctcgacttcaatgagatggtactgctgcagatggaagacaaagcttggctggtgcacaggcaatggttcctagacctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttattatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcatctaggtaagcttgagatggactttgatctctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatttcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagttgggatggtgagcattttagccagttctctcctaaagaatgacattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggactttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacacttctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaatattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataaccctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacggtagaagcaggacgaacacttagagtcctcaacttagtggaaaattggttgaacaataacacccaattttgcgtaaaggttctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaggaagaagacacccaggatgtgtaccagagaagaatttacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcctgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaattacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaacaccttcaccaacatggaagcccaattaattagacagatggagggagaaggaatttttaaaagcattcagcgcctgacagtcacagaagaaatcgctgtgcagaactggttagcaagagtggggcgtgaaaggttatcaagaatggccatcagtggagatgactgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6809 - RNA, 9876 nt, synthetic construct
  misc_feature 1..9876: note = derived and/or modified CDS sequence (wt) from DENV-2__EU482720__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagacacaatcacgtacaagtgtcccctcctcaggcaaaatgaaccagaagacatagattgttggtgcaactccacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaagggggcattgtaacctgtgctatgttcacatgcaaaaagaacatggaaggaaaagttgtgctgccagaaaatctggaatacaccatcgtgataacacctcactcaggagaagagcacgctgtaggcaatgatacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaactggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgcaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtgcaggctgacactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcactggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttttgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagttggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagaaagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaaattaaaacccagatggttggatgctaggacctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggccacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctggtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaactttagcaaaagaaggcatcaaaagaggggaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacactcaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagctacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtatatgtggcttggagcacgtttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttatgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6810 - RNA, 9876 nt, synthetic construct
  misc_feature 1..9876: note = derived and/or modified CDS sequence (wt) from DENV-2__EU482721__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggggttaacatgtgcaccctcatggccatagaccttggtgaattgtgtgaagatacaatcacgtacaagtgtcctctcctcaggcaaaatgaaccagaagacatagattgttggtgcaactccacgtccacatgggtaacttatggaacatgtaccaccacaggagaacacagaagggaaaaaagatcagtggcactcgttccacatgtgggcatgggactggagacacgaactgaaacatggatgtcatcagaaggggcctggaaacacgttcagagaattgaaacctggatcttgagacatccaggctttaccacaatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgatcacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggccctccaccaagttttcggagcaatctatggggctgcttttagtggggtctcatggactatgaaaatcctcataggagttatcatcacatggataggaatgaattcacgtagcacctcactgtctgtgtcactagtattggtgggaatcgtgacactgtacttgggggttatggtacaggctgacactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctgaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgacaacttttcattaggagtcttgggaatggctctgttcctggaagaaatgctcaggacccgaataggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttcaccattgctcttaacatcctcacaacagaaagcggattggataccattggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcctatgacaggtccattagtggctggaggactcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattactggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcaaattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgatagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagagggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgctttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggcaggtggaagggcttacaatcatgctctcagtgaactgccagagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagtaacattctggacatagatctacgtcctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaatccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcagatctacaagaaaagtggaatccaggaagtggatagaactctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacacttagagtcctcaacttagtggaaaattggctgaacaataacactcaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagattgctgacaaaaccttgggacgtcgtccctatggtgacacagatggcaatgacagacacgactccttttggacaacagcgcgttttcaaagagaaagtagacacgagaacccaagaaccgaaggaaggcacaaagaaactgatgaaaattacggcagagtggctttggaaagaactaggaaagaaaaagacacccaggatgtgtaccagagaagaattcacaagaaaagtgagaagcaatgcagccttgggggccatattcactgatgagaacaaatggaaatcggctcgtgaggctgttgaagatggtaggttttgggagctggttgacagggaaagaaatcttcatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtatcaaaacaaggtggtgcgtgtacaaagaccaacaccaagaggcacagtaatggacatcatatcgagaaaagaccaaagaggcagcgggcaagtcggcacctatggccttaatacttttaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcatgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6811 - RNA, 9876 nt, synthetic construct
  misc_feature 1..9876: note = derived and/or modified CDS sequence (wt) from DENV-2__EU482722__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgtgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagttgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaaactttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaatcaattgacctacgtagtcatagccatcctcacagtggtggccgcgaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacactcaattttgcgtaaaggttctcaacccatacatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagctacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttatccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6812 - RNA, 9876 nt, synthetic construct
  misc_feature 1..9876: note = derived and/or modified CDS sequence (wt) from DENV-2__EU482723__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggattggagacacgaactgaaacatggatgtcatcagaaagggcctggaaacatgttcagagaattgaaacctggatcttgagacatccaggctttaccataatggcagcaatcctggcatacaccataggaacgacacatttccaaagggccctgatcttcattttactgacagccgtcgctccttcaatgacaatgcgttgcataggaatatcaaatagagacttcgtagaaggggtttcaggaggaagttgggttgacatagtcttagaacatggaagttgtgtaacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggataaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggactactcttgagaaaattgacctccaaggaactaatgatggccaccataggaatcgcactcctttctcaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtttttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagaggaaagaggatagaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggagaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacatgggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaaccggatcagcatcatctatggtgaacggagttgttaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6813 - RNA, 9876 nt, synthetic construct
  misc_feature 1..9876: note = derived and/or modified CDS sequence (wt) from DENV-2__EU482724__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagactgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgatcttcattctactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgcggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaagcagagcttggaactcgctggaagttgaagactatggttttggagttttttccaccaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccctggcacctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctaccatgacggatgacataggtatgggagtgacttaccttgccctactagcagccttcaaagttagaccaacttttgcagctggattactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacagcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgttcaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacagacccagcaagtatagcagctagaggatatatttcaactcgagtggagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagatgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatagggaagatgaccctgggaatgtgttgtatcatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggcttcctggaaaaaaccaagaaagaccttggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaagggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctacatcttgaagggaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaatatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagccagaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6814 - RNA, 9876 nt, synthetic construct
  misc_feature 1..9876: note = derived and/or modified CDS sequence (wt) from DENV-2__EU482725__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgcaccctcatggccatagaccttggtgaattgtgtgaagatacaatcacgtacaagtgccccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatataccataggaacgacacatttccaaagggctctgatcttcattttactgacagccgttgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgttcacatgcaaaaagaacatggaaggaaaagttgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacgttggtcactttcaaaaatccccacgcgaagaaacaggacgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacacgtcctaggtcgcctgattacagtgaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggggttatggtgcaggctgatactggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaattcgctggaagttgaagactatggttttggagttttttccacaaatatatggctaaaactgagagaaaaacaggatgtattttgtgactcaaaacttatgtcagcggccataaaagacaacagagccgtccatgccgatatgggttattggatagaaagtgcactcaatgacacatggaagatggagaaagcctctttcattgaaatcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcacctaggtaagctcgagatggacttcgatttctgtgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcattaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggtcatggtgggcgctactatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccattggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcctatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggtttgctggtgatctcaggagtctttccagtatcgataccaattacagcagcagcatggtacctgtgggaagtgagaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttagcattggaacctggaaaaaatccaagagccgtccaaacgaaacctggacttttcaaaaccaataccgggaccataggcgccgtatctctggacttttcccctggaacgtcaggatctccaattgtcgacagaaaaggaaaagttgtgggtctttacggtaatggtgttgttacaaggagtggagcatatgtgagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagcccacttcacggacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacggtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataaccctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccaattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgttgtgtgacataggggaatcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaagcacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaattccctgagtggagtggaaggagaagggctgcacaagctaggctacattttaagagatgtgagcaagaaggaagggggagcaatgtacgccgatgacacagcaggatgggacacaagaatcacactagaagacttaaaaaatgaagagatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaataccttcaccaacatggaagcccaattaattagacagatggagggagaaggaatttttaaaagcattcagcgcctgacagtcacagaagaaatcgctgtgcagaactggttagcaagagtggggcgtgaaaggttatcaagaatggccatcagtggagatgactgcgttgtaaaacctttagatgacagatttgcaagtgctttaacagccctaaatgacatgggaaaagttaggaaagatatacaacaatgggaaccttcaagaggatggaacgattggacacaagtgcctttctgttcacatcatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccttgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaaaagattcagaaaggaagaggaagaggcaggtgtcctgtggtag

SEQ ID NO: 6815 - RNA, 9876 nt, synthetic construct
  misc_feature 1..9876: note = derived and/or modified CDS sequence (wt) from DENV-2__EU482726__SS-prME
  source 1..9876: mol_type = other RNA
acagcaggcgtgattgttatgttgattccaacagtgatggcgttccatttaaccacacgcaatggagaaccacacatgatcgttggtaggcaggagaaagggaaaagtctcctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatagttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaacttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacaatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtataggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagtcaacccaatcgtaacagaaaaagatgccccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctgtggtgcaggcagatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaagggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggaaaacttggtcaactccttggtcacagccggacatgggcagattgacaacttttcactaggagtcttgggaatggcactgttcctggaagaaatgcttaggacccgagtaggaacgaaacatgcaacactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggccatttcgtgtgtcccaaatgcagtgatattgcaaaacgcatggaaagtgagttgcacaatattggcagcggtgtccgtttctccactgctcctaacatcctcacagcagaaagcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacatttcatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgatcatcatggacgaagctcacttcacggacccagcaagtatagctgctagaggatatatctcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagccaaaatgctcttagataacatcaacacacctgaaggaatcattcctagcatgttcgaaccagagcgtgaaaaagtggatgccattgatggtgaataccgtctgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctactctgacccactggcactgaaagaattcaaggaatttgcagctggaagaaaatctttgaccctgaacctaatcacagaaatgggcaggcttccaacttttatgactcagaaggcaagagacgcactggacaacttagctgtgctgcatacggctgaggtaggtggaagggcttacaatcatgctctcagtgaactgccggagaccctggagacactgcttttactgacactcctggccacagtcacaggaggaatcttcttattcttaatgagcggaaaaggtatcgggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacacagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagaacagcagcaggcatcatgaaaaatccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtgtcaatggctaacatctttagggggagctacttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacatgaagaacccatccccatgtcaacatatgggtggaatctagtgcgtctgcaaagtggagttgacgttttcttcaccccgccagaaaagtgtgacacattgctgtgtgacataggggaatcgtcaccaaatcccacgatagaagcaggacgaacacttagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggatacgagaacccaagaaccgaaggaaggcacaaagaaactgatgagaatcacggcagagtggctttggaaagaactaggaaagaaaaagacacccaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggctagcaagagtggggcgtgaaaggctatcaagaatggccatcagtggagatgactgtgttgtaaaacccatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6816 - RNA, 9876 nt, synthetic construct
  misc_feature 1..9876: note = derived and/or modified CDS sequence (wt) from DENV-2__EU482727__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaatgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttaccgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggccggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagctgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagattgtgcatattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgcaaaccaagccacagtgctaatgggtctcgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttaattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccaggaggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6817 - RNA, 9876 nt, synthetic construct
  misc_feature 1..9876: note = derived and/or modified CDS sequence (wt) from DENV-2__EU482728__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtccccttctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccctggtagacagaggatggggaaatggatgtggattatttggaaaaggaggcattgtgacctgtgctatgtttacatgtaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttattagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaagggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtactggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcggaatggtgagcattttagccagttctctcctaaagaatgacattcccatgacaggtccattagtggctggagggcttcttactgtgtgttacgtgctcactggacggtcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgttgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctctgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttatttttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaagtatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacatcggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaacactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6818 - RNA, 9876 nt, synthetic construct
  misc_feature 1..9876: note = derived and/or modified CDS sequence (wt) from DENV-2__EU482729__SS-prME
  source 1..9876: mol_type = other RNA
acagcaggcgtgattattatgttgattccaacagcaatggcgttccatttaaccacacgtaatggagaaccacacatgatcgttggtaggcaagaaaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgttgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaagaaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgttcgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagaaattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaatagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctaattgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactgctcctgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaatgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggccggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacgcgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggtttgagaacattaatcctggctcccactagagttgtggcagctgaaatggaggaagctcttagaggacttccaataagataccaaaccccagccatcagagctgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcatattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacttacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgcaaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacacaggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccaggaggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcgcctgacagtcacagaagaaatcgctgtgcagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtagtcccatgcagaaaccaagatgaactgattggtagagcccgaatttctcagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6819 - RNA, 9876 nt, synthetic construct
  misc_feature 1..9876: note = derived and/or modified CDS sequence (wt) from DENV-2__EU482731__SS-prME
  source 1..9876: mol_type = other RNA
acagcaggcgtgattgttatgttgattccaacagtgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatagttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaacttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacaatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagtcaacccaatcgtaacagaaaaagatgccccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatacaagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaagggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggaaaacttggtcaactccttggtcacagccggacatgggcagattgacaacttttcactaggagtcttgggaatggcactgttcctggaagaaatgcttaggacccgagtaggaacgaaacatgcaacactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggccatttcgtgtgtcccaaatgcagtgatattgcaaaacgcatggaaagtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacatttcatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgccatgccacatttactatgaggctgctatcaccagtcagagtgccaaattacaacctgattatcatggacgaagcccacttcacagacccagcaagcatagcagctagaggatacatttcaactcgagtagagatgggtgaagcagcaggtattttcatgacagccactcctccgggaagcagagacccatttcctcagagcaatgcaccaatcatagatgaggagagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgcacaatcatgctctcagtgaactgccggagaccctggagacactgcttctactgacactcctggcaacagtcacaggaggaattttcttattcttaatgagcggaaaaggtatagggaagatgactctgggaatgtgttgcataatcacagctagcatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgctattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaatatggtcacaccggaagggaaggtggtggatcttggttgcggcagagggggctggtcatactattgtgggggactaaagaatgtaagagaagtcaaaggcctaacaaaaggaggaccaggacacgaagaacccatccctatgtcaacatatgggtggaatctagtgcgtctgcaaagtggtgttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtcatagaaaaaatggaaacactacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacccatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6820 - RNA, 9876 nt, synthetic construct
  misc_feature 1..9876: note = derived and/or modified CDS sequence (wt) from DENV-2__EU482732__SS-prME
  source 1..9876: mol_type = other RNA
acagtaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattagattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaattacagcttaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagcgtttacatctataggaaaggctctccaccaagttttcggagcaatctatggggctgcttttagtggggtctcatggactatgaaaatcctcataggagttatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtgttttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccacacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagatctgggaagagtgatggttatggtgggcgctaccatgacggatgacataggtatgggagtgacttaccttgccctactagcagccttcaaagttagaccaacttttgcagctggactactcttgagaaaattgacctccaaggaactaatgatggccactataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacatacactgaccatactaatcagaacgggattgctggtgatctcaggagtctttccagtatcgataccaattacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagagaattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggcaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtcatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggcaggctcccaacttttatgactcagaaggcaagagacgcactggacaacttagctgtgctgcatacggctgaggtaggaggaagggcgtacaatcatgccctcagtgaactgccggagaccctggagacactgcttttactgacactcctggccacagtcacaggaggaatcttcttattcttaatgagcggaaaaggtatagggaagatgaccctgggaatgtgttgtataatcacagctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacattctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttctactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttctggaacactaccattgcagtatcaatggctaacatctttagggggagctatttggccggagctggactcctcttttccatcatgaagaacacaacaaatacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaacatggtcacaccagaagggaaggtggtggacctcggttgcggcagagggggctggtcatactattgtgggggactgaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcaaactgctgacaaaaccttgggacgttgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatcttcatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaacactttcaccaacatggaagcccaattaatcagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagccctaaatgacatgggaaaagttaggaaagatatacaacaatgggaaccttcaagaggatggaacgattggacacaagtgcctttctgttcacaccatttccatgagctagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggacccttatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggctacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6821 - RNA, 9876 nt, synthetic construct
  misc_feature 1..9876: note = derived and/or modified CDS sequence (wt) from DENV-2__EU482733__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtccccttctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccatagggacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgttacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaagggaatcatgcaggcaggaaaacgatctttgcggccccagcccactgagctgaagtactcatggaaaacatggggaaaggcgaaaatgctctccacagagtctcacaatcagaccttccttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtactggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatctggtcaactccttggtcacagccggacatgggcagattgataacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaattgacctccaaggaactaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacaacagaaagcggattggataccactggcattgacgataaaaggtctcaatccaacagccatctttctaacaactctttcgagaaccagcaagaaaaggagctggccgctaaatgaagctgtcatggcagtcggaatggtgagcattttagccagttctctcctaaagaatgacattcccatgacaggtccattagtggctggagggcttcttactgtgtgttacgtgctcactggacggtcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtgttgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcttggcattggaacctggaaaaaatccaagagccgtccaaacgaaacctggacttttcaaaaccaataccggaaccataggcgccgtatctctggacttttcccctggaacgtcaggatctccaattgttgacagaaaaggaaaagttgtgggtctttacggtaatggtgttgttacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctctgaccctgaatctaatcacagaaatgggcaggcttccaactttcatgactcagaaggcaagagacgcactggacaacttagctgtgctgcatacggctgaggtaggtggaagggcgtacaatcatgctctcagtgaactgccggagaccctggagacactgcttttactgacactcctggccacagtgacaggaggaatcttcttatttttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgacagggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaacatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgacacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacatcggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgttgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaacactttcaccaacatggaagcccaattaattagacagatggagggagaaggaatttttaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccatttccatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6822 - RNA, 9876 nt, synthetic construct
  misc_feature 1..9876: note = derived and/or modified CDS sequence (wt) from DENV-2__EU482734__SS-prME
  source 1..9876: mol_type = other RNA
acagcaggcgtgattgttatgttgattccaacagcgatggcgtttcatttaaccacacgcaatggagaaccacacatgatcgttggtaggcaggagaaaggaaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggggaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcatgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggacggttctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggagtgtttacatctgtaggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctctacagagtctcacaatcagacctttcttattgatggccctgaaacagcagaatgccccaacacaaacagagcttggaactcgctggaagtcgaagactatggttttggagtttttaccaccaatatatggctaaaattgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggactgtggaaatagaggaccttctttaagaacgaccactgcctctggaaaactcataacagaatggtgctgccgatcctgtacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggtgctaccatgacggatgacataggtatgggagtgacttatcttgccctactagcagctttcaaagttagaccaacttttgcagctggactactcttgagaaaactgacctccaaggaattaatgatggccaccataggaatcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccgctaaatgaagctatcatggcagttgggatggtgagcattttagccagttctctcctgaagaatgatattcccatgacaggtccattagtggctggagggctccttacagtatgttacgtgctcactggacgatcggccgatttggaactagagagagctgccgatgtaaaatgggaagatcaggcagaaatatcaggaagcagcccaatcctgtcaataacaatatcagaagatggcagcatgtcgataagaaatgaagaggaagaacaaacactgaccatactcatcagaacgggattgttggtgatctcaggagtctttccagtatcgataccagttacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctagtatcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagaaatcgaagatgacattttccgaaagaaaagattgaccatcatggaccttcatccaggagcaggaaagacaaaaagataccttccagccatagttagagaagccataaaacgtggcttgagaacattaatcctggctcccaccagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaaccttcgtggacctaatgagaagaggggacttaccagtctggttagcctacaaagtggcagctgaaggcatcaactacgcagacagaaggtggtgttttgatggaattaagaataaccaaatactggaagaaaatgtggaagtggaaatctggacaaaagaaggggaaaggaaaaaattaaaacccagatggttggatgctaggatctattctgacccactggcactaaaagaattcaaggaatttgcagccgggagaaaatctttgaccctgaatctaatcacagaaatgggtaggcttccaactttcatgactcagaaggcaagaaacgcactggacaacttggctgtgctgcatacggctgaggcaggtggaaaggcgtataatcatgctctcagtgaactgccggagaccctggagacactgcttctactaacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggccacaacatttgtcacaccaatgttgaggcatagcattgaaaattcctcagtgaatgtctccctaacagccattgctaaccaagctacagtgctaatgggtcttgggaaaggatggccattgtcaaagatggacatcggagttcccctcctcgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatcaccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgagatgtactgggtatctaatgccactgggaacatagtgtcatcagtgaacatgatttcaaggatgttgattaacagattcacaatgaaacacaagaaagccacctacgagccggatgttgacctgggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacccaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgagacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaagctagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagtcacagaagaaatcgctgtacagaactggctagcaagagtggggcgtgaaaggctatcaagaatggccatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccaaggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacgagtcgaacaacctggtccatacacgctaagcatgaatggatgacgacggaggacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 6823 - RNA, 9876 nt, synthetic construct
  misc_feature 1..9876: note = derived and/or modified CDS sequence (wt) from DENV-2__EU482735__SS-prME
  source 1..9876: mol_type = other RNA
acagcaggcgtgattgttatgttgattccaacagcgatggcgtttcatttaaccacacgcaatggagaaccacacatgatcgttggtaggcaggagaaaggaaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggggaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtgcagccagaaaatttggaatacaccatcatgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacacaacatggaacaatagttatcagagtacaatatgaaggggacggttctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggattttggatccctgggaggagtgtttacatctgtaggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctctgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagtcgaagactatggttttggagtttttaccaccaatatatggctaaaattgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggactgtggaaatagaggaccttctttaagaacgaccactgcctctggaaaactcataacagaatggtgctgccgatcctgtacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggtgctaccatgacggatgacataggtatgggagtgacttatcttgccctactagcagctttcaaagttagaccaacttttgcagctggactactcttgagaaaactgacctccaaggaattaatgatggccaccataggaatcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccgctaaatgaagctatcatggcagttgggatggtgagcattttagccagttctctcctgaagaatgatattcccatgacaggtccattagtggctggagggctccttacagtatgttacgtgctcactggacgatcggccgatttggaactagagagagctgccgatgtaaaatgggaagatcaggcagaaatatcaggaagcagcccaatcctgtcaataacaatatcagaagatggcagcatgtcgataagaaatgaagaggaagaacaaacactgaccatactcatcagaacgggattgttggtgatctcaggagtctttccagtatcgataccagttacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctagtatcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagaaatcgaagatgacattttccgaaagaaaagattgaccatcatggaccttcatccaggagcaggaaagacaaaaagataccttccagccatagttagagaagccataaaacgtggcttgagaacattaatcctggctcccaccagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaaccttcgtggacctaatgagaagaggggacttaccagtctggttagcctacaaagtggcagctgaaggcatcaactacgcagacagaaggtggtgttttgatggaattaagaataaccaaatactggaagaaaatgtggaagtggaaatctggacaaaagaaggggaaaggaaaaaattaaaacccagatggttggatgctaggatctattctgacccactggcactaaaagaattcaaggaatttgcagccgggagaaaatctttgaccctgaatctaatcacagaaatgggtaggcttccaactttcatgactcagaaggcaagaaacgcactggacaacttggctgtgctgcatacggctgaggcaggtggaaaggcgtataatcatgctctcagtgaactgccggagaccctggagacactgcttctactaacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggccacaacatttgtcacaccaatgttgaggcatagcattgaaaattcctcagtgaatgtctccctaacagccattgctaaccaagctacagtgctaatgggtcttgggaaaggatggccattgtcaaagatggacatcggagttcccctcctcgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaacgatgaggactacatgggctttgtgcgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgagatgtactgggtatctaatgccactgggaacatagtgtcatcagtgaacatgatttcaaggatgttgattaacagattcacaatgaaacacaagaaagccacctacgagccggatgttgacttgggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagacacccaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgagacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaagctagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagtcacagaagaaatcgctgtacagaactggctagcaagagtggggcgtgaaaggctatcaagaatggccatcagtggagatgattgtgttgtaaaacccatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccaaggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacgagtcgaacaacctggtccatacacgctaagcatgaatggatgacgacggaggacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 6824 - RNA, 9876 nt, synthetic construct
  misc_feature 1..9876: note = derived and/or modified CDS sequence (wt) from DENV-2__EU482736__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacaacacatttccaaagggccttgattttcatcttactgacggccgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgttgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgagcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6825 - RNA, 9876 nt, synthetic construct
  misc_feature 1..9876: note = derived and/or modified CDS sequence (wt) from DENV-2__EU482737__SS-prME
  source 1..9876: mol_type = other RNA
acagcaggcgtgattgttatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggccgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgttgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgagcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaggccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccttttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtctcaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagctcaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6826 - RNA, 9876 nt, synthetic construct
  misc_feature 1..9876: note = derived and/or modified CDS sequence (wt) from DENV-2__EU482739__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggcatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagccgtcgctccttcaatgacaatgcgttgcataggaatatcaaatagagacttcgtagaaggggtttcaggaggaagttgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttctatcacagaagcagaactgacaggctatggcactgtcacgatggagtgctctccgagaacgggcctcgacttcaatgagatggtgctgctgcagatggaagacaaagcctggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcacttacaggggccacagaaatccagatgtcatcaggaaacttgctgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggttcaagaagggaagttccattggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggaccatgaaaatcctcataggagtcatcatcacatggataggaatgaattcacgtagcacctcactgtctgtgtcactagtattggtgggagtcgtgacactgtacttgggagttatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataatcccaaaaaattttgccgggccagtgtcacaacacaactacagaccaggctaccatacacaaacagcaggaccttggcatctaggtaagctcgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggctctgttcctggaagaaatgctcaggacccgagtaggaacgaaacatgcaatactgctagttgcagtatctttcgtgacattgattaccgggaacatgtcctttagagacctgggaagagtgatggttatggtgggcgctaccatgacggatgacataggtatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatctggaaaagtaccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaatcacggcagcagcatggtacctgtgggaagtgaaaaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaataccggaaccataggcgccgtatctctggacttttcccctggaacgtcaggatctccaattgtcgacagaaaaggaaaagttgtgggtctttacggtaatggtgttgttacaaggagtggagcatatgtgagtgctatagcccagacggaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcaggtcatgaatgggtcacggacttcaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactatgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactgaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcatacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggagaggatggccattgtcaaagatggacatcggagttcccctccttgccattggatgctattcacaagtcaaccctataactctcacagcagctcttcttttactggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctagtcctctgcgtgactcaagtattaatgatgaggactacatgggctctgtgtgaggctctaaccttagcgaccgggcccatctccacactgtgggaaggaaatccagggaggttttggaacactaccattgcagtatcaatggctaacatctttagggggagctacttggccggagctggactcctcttttccatcatgaagaacacaacaaacacaagaagaggaactggcaacataggagagacacttggagaaaaatggaaaagccgattaaacgcactgggaaaaagtgaatttcagacctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttggtgaggaatccactctcacgaaactccacacatgagatgtactgggtatccaatgctaccgggaacatagtgtcatcagtgaacatgatttcaaggatgttgattaacagattcacaatgaaacacaagaaagccacttacgagccagatgttgacctaggaagcggaacccgcaacattggaattgaaaatgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagttgtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaagctaggctacattttaagagacgtgagcaagaaggaagggggagcaatgtacgccgatgatacagcaggatgggacacaagaatcacactagaagacttaaaaaatgaagaaatggtaacaaaccatatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagcgggcaagtcggcacctatggccttaatactttcaccaacatggaagcccaattaattagacagatggagggagaaggaatttttaaaagcattcagcacctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtggtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttagggaaaagagaagaccaatggtgcggctcattgattgggctaacaagcagggccacctgggcaaagaacatccaaacagcgataaatcaagtcagatcccttataggcaatgaggaatacacagactacatgccatccatgaagagattcagaaaggaagaggaagaggcaggtgtcctgtggtag

SEQ ID NO: 6827 - RNA, 9876 nt, synthetic construct
  misc_feature 1..9876: note = derived and/or modified CDS sequence (wt) from DENV-2__EU482740__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggcttcaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcctagaacatggaagttgtgtgacgacgatggcaaagaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattattcggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcaaagaaacaggatgtcgttgttttaggatctcaagaaggggccatgcacacggcactcacaggagccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaacgacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcagccaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagccgccataaaagacaacagagccgtccatgccgacatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgtgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttaggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgatataggtatgggagtgacttatcttgccctactagcagctttcaaagttagaccaacttttgcagctggactactcttgagaaaactgacctccaaggaattgatgatggccaccataggaatcgcactcctttcccaaagcaccataccagagaccattctagaactgactgatgcgttagccttgggcatgatggtcctcaagatagtgagaaatatggaaaagtaccaattggcagtgactatcatggctatctcgtgtgtcccaaatgcagtgatattgcaaaacgcatggaaggtgagttgcacaatattggcagtggtgtccgtttctccactgcttttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaagaagaacaaacactgactatactcattagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtctacaaagaaggaacattccatacaatgtggcacgtcacacgtggtgctgtcctgatgcatagagggaagaggattgaaccatcatgggcagacgtcaagaaggacctaatatcatatggaggaggctggaaactagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgactatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagagagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtttggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaagcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataattacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaaaaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacctggccggagctggacttctcttttccatcatgaagaacacaacaaacacaagaagaggaactggtaacataggagagacacttggagaaaaatggaaaagccgattaaacgcactggggaaaagtgaatttcagatctacaagaaaagtggaatccaggaagtggatagaaccttagcaaaagaaggcataaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcgtaaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaactaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaacactttcaccaacatggaagcccaattaattagacagatggagggggaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcgaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6828 - RNA, 9876 nt, synthetic construct
  misc_feature 1..9876: note = derived and/or modified CDS sequence (wt) from DENV-2__EU482741__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggacggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacatgtgggtatgggactggagacacgaactgaaacatggatgtcatcggaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtgacaagattggagaatctgatgtggaaacaaataacaccagaattgaatcacattctatcagaaaatgaggtaaagttgaccattatgacaggagacatcaaaggaatcatgcaggcaggaaaacgatctttgaggccccagcccactgagctgaagtactcatggaagacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaagcatgcaatgctgctagttgtagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgagaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtggaaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgctgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggattttgtggtcacaactgacatttcagaaatgggtgccaacttcaaggctgaaagggttatagaccccagacgttgcatgaaaccagtcatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctggataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctatagctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaattgagatggttcgtcgagagaaatatggtcacaccggaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaacctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaattagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaacactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6829 - RNA, 9876 nt, synthetic construct
  misc_feature 1..9876: note = derived and/or modified CDS sequence (wt) from DENV-2__EU482742__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccccagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgttatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaattgccggagaccctggagacactgcttttactgacactcctggccgcagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataaccctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagacgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaactcaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcgcattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6830 - RNA, 9876 nt, synthetic construct
  misc_feature 1..9876: note = derived and/or modified CDS sequence (wt) from DENV-2__EU482744__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggtagacatagtcttagaacatggaagttgtgtgacgacgatggcaaaaaataaaccaacattggattttgaactgataaaaacagaagccaaacagcctgccactctaaggaagtactgtatagaagcaaagctgaccaatacaaccacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagctgaccattatgacaggagacattaaaggaatcatgcaggcaggaaaacgatctttgaggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaggacaacagagccgtccatgccgatatgggttattggatagaaagtgcactcaatgacacatggaagatggagaaagcctctttcattgaagttaaaagctgccactggccaaagtcacacactctctggagcaatggagtattggaaagtgagatgataattccaaaaaattttgctgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacagatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgagtatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgactatactcatcagaacgggattgttggtgatctcaggagtctttccagtatcgataccaatcacggcagcagcatggtatttgtgggaagtgaagaaacaacgggctggagtattgtgggacgtcccttcacccccaccagtgggaaaagccgaactggaagatggagcctatagaatcaagcaaagagggattcttggatattcccagattggagctggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagctcacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctcttagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtagccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatttttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgatctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgttgtccctatggtgacacagatggcaatgacagacacgactccatttggacaacaacgcgttttcaaagagaaagtggacacgagaacccaagaaccgaaggaaggcacaaagaaattgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgtttcttagagtttgaagccctaggattcttgaatgaagatcactggttctccagagggaactccctgagtggagtggaaggagaagggctgcacagactaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagttacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtatttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattaattgggctaacaagcagggctacctgggctaagaacatccaaacagcaataaatcaagtcagatcccttataggcaatgaggaatacacagactacatgccatctatgaagagattcagaaaggaagaggaagaggccggtgtcctgtggtag

SEQ ID NO: 6831 - RNA, 9876 nt, synthetic construct
  misc_feature 1..9876: note = derived and/or modified CDS sequence (wt) from DENV-2__EU482745__SS-prME
  source 1..9876: mol_type = other RNA
acagcaggcgtgattattatgttgattccaacagcgatggcgttccatttaaccacacgtaatggagaaccacacatgatcgttggtaggcaagagaaggggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactttaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacaccccactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctaattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaactcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcggacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggtaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttatcttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcagggagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaaccaaggaatctgagagcaacatcctggacatagatctacgtcctgcatcagcatggacgttgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcaaatcccttataggcaatgaggaatacacagactacatgccatccatgaagagattcagaagggaagaggaagaggccggtgtcctgtggtag

SEQ ID NO: 6832 - RNA, 9876 nt, synthetic construct
  misc_feature 1..9876: note = derived and/or modified CDS sequence (wt) from DENV-2__EU482746__SS-prME
  source 1..9876: mol_type = other RNA
acagcaggcgtgattattatgttgattccaacagcgatggcgttccatttaaccacacgtaatggagaaccacacatgatcgttggtaggcaagagaaggggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttacgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctaattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcattacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagtctcacaatcggacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggtaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggtcatggtgggcgctaccatgacggatgacataggtatgggagtgacttatcttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttagaaaaaatggaaagaaagtgatacaactcagtaggaagacttttgattctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattacaacccaggaatctgagagcaacatcctggacatagatctacgtcctgcatcagcatggacgttgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6833 - RNA, 9876 nt, synthetic construct
  misc_feature 1..9876: note = derived and/or modified CDS sequence (wt) from DENV-2__EU482590__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgatttttatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacagcctgccactctaaggaagtactgtatagaagcaaagctgaccaatacaaccacagaatctcgttgcccaacacaaggggagcccagtctaaatgaagagcaggacaaaaggttcgtctgcaaacactccatggtggacagaggatggggaaatggatgtggattatttggaaagggaggcattgtgacctgtgctatgttcacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccgttttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcataacagataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaaaacatggggaaaggcgaaaatgctctccacagagcctcacaatcagacctttcttattgatggccctgaaacagcagaatgccccaacacaaacagagcttggaactcgctggaagttgaagactatggttttggagtttttaccaccaacatatggctaaaactgagagaaaaacaggatgtattttgtgactcaaaactcatgtcagcggccataaaggacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgacttctgcgaaggaaccacagtggtggtgactgaggactgcggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggcatgggagtgacttatcttgccctactagcagctttcaaagttagaccaacttttgcagctggactactcctgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgactatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagataatccagaaatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtagcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcctggatgaggaaagagaaatccctgagcgttcgtggaattcaggacatgaatgggtcacggattttaaagggaagactgtatggtttgttccaagtataaaagcaggaaatgacatagcagcttgtcttaggaagaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgctcattggaaagaagctaaaatgcttctagacaacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccgctggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggtaggtggaagggcgtacaatcatgctctcagtgaactgccggagaccctggagacactgcttttactgacacttctggccacagtcacaggaggaatcttcttattcttaatgagcggaaaaggcatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaaccccccaagacaaccaattgacctacgttgtcatagccatcctcacagtggtagccgcaaccatggcaaacgagatgggtttcctggagaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatatctccctaacagctattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaggctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaattgagatggttcgtcgagagaaatatggtcacaccagaagggaaggtggtggacctcggttgcggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaagttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgatctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctttggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgatcgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttatgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctagcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatctatgaagagattcagaagggaagaggaagaggccggtgtcctgtggtag

SEQ ID NO: 6834 - RNA, 9876 nt, synthetic construct
  misc_feature 1..9876: note = derived and/or modified CDS sequence (wt) from DENV-2__EU482594__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgtaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacggctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggactttgaactgataaaaacagaagccaaacagcctgccactctaaggaagtactgtatagaagcaaagctgaccaatacaacaacagaatctcgttgcccaacacaaggggaacccagtctaaatgaagagcaggacaaaaggttcgtctgcaaacactccatggtggacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacggaagcagaactgacaggctatggcactgtcacgatggagtgctctccgagaacaggtctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaagtaaagaactgaaatgtggcagcgggatcttcatcacggataacgtgcacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctttgaggccccagcccactgagctgaagtactcatggaagacatggggaaaagcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggctataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgtcgatcctgcacactaccacctctaagatacagaggtgaggatggatgctggtacgggatggaaatcagaccattgaaagagaaagaggaaaatttggtcaactccttggtcacagccggacatgggcagattgacaacttttcactaggagtcttgggaatggcactgttcctggaagaaatgctcaggacccgagtaggaacgaaacatgcaatactgctagttgcagtatcctttgtgacattgattactgggaacatgtcctttagagacctgggaagagtgatggttatggtgggcgctaccatgacggatgacataggtatgggaataacttatcttgctctactagcagctttcaaagtcagaccaacttttgcagctggactactcttgaaaaaactgacctccaaggaattaatgatggccaccataggaatcgcactcctttcccaaagcaccataccagagaccattcttgaactgactgacgcgttagccttgggcatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaggatggcagcatgtcgataaaaaatgaagaggaagaacaaacactgactatactcatcagaacgggattgttggtgatctcaggagtctttccagtatcgataccaattacggcagcagcatggtacttgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagagggaagaggattgaaccatcatgggcagacgtcaagaaggacctaatatcatatggaggaggctggaagctagaaggagaatggaaggaaggagaggaagtccaagtcctggcgttggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggatctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtatggtttgttccaagtataaaagcaggaaatgacatagcagcttgtcttaggaaaaatggaaagaaagtgatacaactcagtaggaagacttttgattctgagtatgttaagactagagccaatgattgggactttgtggtcacaactgacatttcagaaatgggtgccaacttcaaggctgaaagggttatagaccccagacgttgcatgaaaccagttatactaacagaaggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgcttctagataacatcaacacacctgaaggaatcattcctagtatgttcgaaccagagcgtgaaaaggtggatgccatcgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaaccccccaagacaaccaattgacctacgttgtcatagccatcctcacagtggtggccgcaaccatggcaaacgagatgggtttcctggagaaaaccaagaaagacctcggattgggaagcattgcaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagctattgctaaccaagccacagtgctaatgggtcttgggaaaggatggccattgtcaaagatggacatcggagttcccctccttgccattggatgctactcacaagtcaaccctataactctcacagcagcccttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggaccacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccatgctgtgtcgcgaggctcagcaaaactgagatggttcgtcgagagaaatatggtcacaccagaagggaaggtggtggacctcggttgtggcagagggggttggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacttaggaagcggaacccgcaacattggaattgaaagtgagataccaaacctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaattacggcagagtggctctggaaagaactaggaaagaaaaagacacctaggatgtgtaccagagaagaatttacaagaaaggtgagaagcaatgcagccttgggggccatattcactgatgagaacaaatggaaatcggcacgtgaggctgttgaagatagtaggttttgggagctgattgacagggaaagaaatctccatcttgaaggaaagtgtgaaacatgcgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctacggccttaatactttcaccaacatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttggatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggccgcgtgctcgtagtcccatgcagaaaccaagatgaactgattggtagagcccgaatctcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaggaaaacccgtggatggaagacaaaactccagtggaatcatgggaagaagtcccatacttggggaaaagagaagaccaatggtgcggttcattgattgggctaacaagcagggccacctgggcaaagaacatccaaacagcaataaatcaagtcagatcccttataggcaatgaggaatacacagactacatgccatccatgaagagattcagaagggaagaggaagaggccggtgtcctgtggtag

SEQ ID NO: 6835 - RNA, 9876 nt, synthetic construct
  misc_feature 1..9876: note = derived and/or modified CDS sequence (wt) from DENV-2__EU482604__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgccaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaagcgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagttgatgagaatcacggcagagtggctttggaaagaactaggaaagaaaaagacccctagaatgtgcaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6836 - RNA, 9876 nt, synthetic construct
  misc_feature 1..9876: note = derived and/or modified CDS sequence (wt) from DENV-2__EU482605__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactggtcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagccaatccagagatcgaagatgccattttccgaaaaaaaagattgaccatcatggacctccatccaggagcaggaaagccaaaaagatcccttccagccatagtcagagaagccataaagcgtggcttgagaccattaattctggctccccctagagtcgtgccagctgaaatggaggaacctcttagaggcctcccaataagataccaaaccccagccatcaaacccgaccataccggccgggagatcgtggccctaatgtgccatgccccatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcttatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaggttgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6837 - RNA, 9876 nt, synthetic construct
  misc_feature 1..9876: note = derived and/or modified CDS sequence (wt) from DENV-2__EU482606__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgccaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaagcgtggcttgagaacattaattctggctcccactagagtcgtggcagctgaaatggaggaagctcttagaggactcccaataagataccaaaccccagccatcaaagccgagcataccgggcgggagatcgtggacctaatgtgccatcccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagttgatgagaatcacggcagagtggctttggaaagaactaggaaagaaaaagacccctagaatgtgcaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6838 - RNA, 9876 nt, synthetic construct
  misc_feature 1..9876: note = derived and/or modified CDS sequence (wt) from DENV-2__EU482607__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacctacaagtgtcctctcctcagacaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggagtatcaaatagagacttcgtagaaggggtttcaggaggaagctgggttgatatagtcttggaacatggaagttgtgtgacgacgatggcaaaaaacaaaccaacattggattttgaactgataaaaacagaagccaaacaacctgccactctaaggaaatactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtagtgcagccagaaaatttggaatacaccatcgtgataacacctcactcaggagaagagcacgctgtaggtaatgacacaggaaaacatggcaaggaaatcaaaataacaccacagagttccatcatagaagcagaactgacaggctatggcactgtcacgatggagtgctctccgagaacgggccttgacttcaatgagatggtgctgctgcagatggaagacaaagcttggctggtgcacaggcaatggttcctagacctgccgttaccgtggctacctggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttgggccgcctgatcacagttaacccaatcgtaacaggaaaagatagcccagtcaacatagaagcagaacctccattcggggacagctacatcatcataggagtagagccgggacaattgaaactcaattggtttaagaagggaagttccatcggccaaatgttcgagacaacaatgagaggagcaaagagaatggctattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgcggaatccgctcagtaacaagattggagaacctgatgtggaaacaaataacaccagaattgaatcatattctatcagaaaatgaagtaaagttgaccattatgacaggagacattaaaggaatcatgcaagcaggaaaacgatccttgcggccccagcccactgagctgaagtactcatggaaaacatggggaaaggcgaaaatgctctccacagaatctcacaaccagacctttcttattgatggccctgaaacagcagaatgccccaatacaaacagagcttggaactcactggaagttgaagactatggttttggagtttttaccaccaatatatggctaaaattgagagaaaaacaggatgtattttgtgactcaaaactcatgtcagcggccatcaaagacaacagagccgttcacgccgatatgggttattggatagaaagcgcactcaatgacacatggaagatggagaaagcctccttcattgaagttaaaagctgccattggccaaagtcacacaccctttggagcaatggagtattagagagtgagatgataattccaaaaaactttgccgggccagtgtcacaacacaactacagaccaggctaccatacacaaacagcaggaccttggcatctaggtaagcttgagatggactttgatttctgcgaaggaactacagtagtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgcaaccatgacggatgacataggtatgggagtgacttatcttgccctactagcagctttcaaagttagaccaacttttgcagctggactactcttgagaaaactgacctccaaagaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactgtcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttactgtatgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcgtggtacctgtgggaagtgaagaaacaacgggctggagtattgtgggacgttccttcacccccaccagtgggaaaagccgaactggaggatggagcctacagaattaagcaaagagggattcttggatattctcagattggagccggagtttacaaagaaggaacattccatacaatgtggcacgtcacacgtggtgctgtcctgatgcatagagggaagaggattgaaccatcatgggcagatgtcaagaaagacttaatatcatatggaggaggctggaagctagaaggagaatggaaggaaggagaggaagtccaagtcctggcactggaacctggaaaaaatccaagagccgtccaaacaaaacctggaattttcaaaaccgacaccggaaccataggcgccgtatctctggacttttcccctggaacgtcaggatctccaattgtcgacagaaagggaaaggttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagccgaaatggaggaagctcttagaggacttccaataagataccaaaccccagccatcaaagccgaacacaccgggcgggagattgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagacagtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaatttcaaggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttggccctgaacctaatcacagaaatgggtaggcttccaactttcatgacccagaaggcaagaaacgcactggacaacttggctgtgctgcatacggctgaggcaggtggaagggcgtacaatcatgctctcagtgaactgccggagactctggagacactgcttctactgacactcctggcaacagtcacaggaggaatcttcttattcttaatgagcggaaaaggtatagggaagatgaccctgggaatgtgttgcataatcacggctagtgtcctcctatggtatgcacagatacaaccacactggatagcagcttcaataatactggagttttttctcatagttttgctcattccagagccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattataggcccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacactaccatcgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcgctggggaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatacatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactactgacaaaaccttgggacgtcgtccctatggtgacacagatggcaatgacagacacgactccatttggacaacagcgcgttttcaaggagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcaccgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaagcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggatacaagaatcacactagaagatttaaaaaatgaagaaatggtaacaaaccacatgaaaggagaacacaagaaactagctgaggccatattcaaattaacgtaccaaaataaggtggtgcgtgtgcaaagaccaacaccaagaggcacagtaatggatatcatatcgagaaaagaccaaagaggcagtggacaagtcggcacctatggccttaatactttcaccaatatggaagcccaattaatcagacagatggaaggagaaggaatctttaaaagcattcagcacctgacagccacagaagaaatcgctgtacagaactggttaacaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgtggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgttctgtggtag

SEQ ID NO: 6839 - RNA, 9876 nt, synthetic construct
  misc_feature 1..9876: note = derived and/or modified CDS sequence (wt) from DENV-2__EU482608__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccatcttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcaaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaagcgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcatgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcttatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaggttgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaatcaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactcctgtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6840 - RNA, 9876 nt, synthetic construct
  misc_feature 1..9876: note = derived and/or modified CDS sequence (wt) from DENV-2__EU687220__SS-prME
  source 1..9876: mol_type = other RNA
acagcaggcgtgattattatgttaattccaacagcaatggcgttccatttaaccacacgtaatggagaaccacacatgattgttggtaggcaagagaaaggaaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacatatgggacatgtaccaccacaggagaacacagaagagaaaaaagatcagtggcactcgttccacacgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaaaggccttgatttttattttactgacagctgtcgctccttcaatgacaatgcgttgtataggaatatcaaatagagacttcgtagaaggggtttcaggaggaagctgggttgacatagtcttagaacatggaagttgtgtgacgacgatggcaaagaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgctgccagaaaatctggaatacaccatcgtgataacacctcactcaggagaagagcacgccgtaggcaatgacacaggaaaacatggcaaggaaatcaaaataacaccacagagttccatcacagaagcagaactgacaggctatggcactgtcacgatggagtgctctccgagaacgggtctcgacttcaatgagatggtgctgctgcagatggaagagaaagcttggctggtgcacaggcaatggttcctagacctgccgctaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccaatcaacatagaagcagaacctccattcggagacagctacatcatcataggagtagagccgggacaattgaaactcaattggtttaagaagggaagttccatcggccaaatgtttgagacaacaatgagaggagcgaagagaatggctattttaggtgacacagcctgggattttggatccctgggaggagtgtttacatctataggaaaggctctccaccaagtttttggagcaatctatggggctgcttttagtggggtctcatggactatgaaaatcctcataggagtcatcatcacatggataggaatgaattcacgaagcacctcactgtctgtgtcactagtattggtgggagtcgtgacactgtacctgggagctatggtgcaggctgatagtggttgcgttgtgagctggaaaaacaaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccatcatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcggaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacataccctctggagcaatggagtattggaaagtgaaatgataattccaaaaaattttgccgggccagtgtcacaacacaactacagaccaggctaccacacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacaaaacatgcaatactgctagttgcagtatcttttgtgacattgattactgggaacatgtcctttagagacctgggaagagtgatggttatggtgggcgctaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgaggaatatggaaaagtaccaattggcagtgactatcatggctatctcgtgtgtcccaaatgcagtgatactgctaaacgcatggaaggtgagttgcacaatactggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcatcttagccagttctctcctaaagaatgacattcccatgacaggtccattagtggctggagggctccttaccgtgtgttacgtgctcactggacgatcggccgatttggaactggagagagctgccgatgtaaaatgggaagatcacgcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaagaaacaacgggctggagtattgtgggacgttccttcacccccaccagtgggaaaagccgaactggaagatggagcctatagaatcaagcaaagagggattcttggatattctcagattggagccggagtttacaaagaaggaacattccacacaatgtggcacgtcacacgtggtgctgttctgatgcatagagggaagaggattgaaccatcatgggcagacgtcaagaaagacctaatatcatatggaggaggctggaagttagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgccatagcccagaccgaaaaaagcattgaagacaatccagagatcgaagatgacattttccgaaagaagagattgaccatcatggacctccatccaggagcaggaaagacaaaaagataccttccagccatagttagagaagccataaaacgtggcttgagaacgttaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaacccgagtagaaatgggtgaagcagctgggattttcatgacagccactcctccgggaagtagagacccgtttcctcagagcaatgcaccaatcatggatgaggaaagagaaatccctgagcgctcgtggaattcaggacatgaatgggttacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacgaaagaaggggaaaggaagaaattaaaacccagatggttggatgctaggatctattctgacccactggcactaaaagaattcaaggagtttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttgctgacactcctggctacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgcttattccagaaccagaaaaacagagaacaccccaagacaaccaattgacctacgtagttatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtgttaatgatgaggactacatgggctctgtgtgaggctctaaccctagcgaccgggcccatctccacactgtgggaaggaaatccagggaggttttggaacactaccattgcggtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaacatggtcacaccagaagggaaggtggtggacctcggttgtggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagtcgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaagaaaatatggaggagccttagtgaggaatccactctcacgaaactccacacatgagatgtactgggtatccaatgctaccgggaacatagtgtcatcagtgaacatgatctcaaggatgttgattaacagattcacaatgaaacacaagaaagccacctacgagccagatgttgacctaggaagcggaacccgcaacattggaattgaaagtgagataccaaatctagacataataggaaaaagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactactgacaaaaccttgggacgtcgtccctatggtgacacagatggcaatgacagacacgactccttttggacaacaacgcgttttcaaagagaaagtggacacgagaacccaagaaccgaaggagggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcgatgtacgccgatgatacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggcacagtaatggacatcatatcgagaagagaccaaagaggcagtgggcaagttggcacctatggccttaatactttcaccaacatggaagcccaattaattagacagatggagggagaaggaatcttcaaaagcattcagcacctgacagtcacagaagaaatcgctgtacagaactggttagtaagagtggggcgtgaaaggctatcaagaatggccatcagtggagatgattgtgttgtaaaacctttagatgacagatttgcaagtgctttaacagccctaaatgacatggggaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcctgtttgggaaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtatggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6841 - RNA, 9876 nt, synthetic construct
  misc_feature 1..9876: note = derived and/or modified CDS sequence (wt) from DENV-2__EU726775__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgtttaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaagaataaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattcccaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaatatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatactatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcagaaccaacaccggaaccataggcgccatatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcaaagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgaatatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcggctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctctctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtaattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcagaagcattcagcacctgacagccacagaagaaatcgctgtacagaactggttagcaagagtggggcgcgaaaggctatcaagaatggcaatcagtggagatgattgtgtcgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6842 - RNA, 9876 nt, synthetic construct
  misc_feature 1..9876: note = derived and/or modified CDS sequence (wt) from DENV-2__FJ639732__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaattacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcattacagataacgtacacacatggacagaacaatacaagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccgtcaaagacaacagagctgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttaagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaactagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgattatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagctaatgattgggactttgtggtcacgactgacatttcagaaatgggtgccaacttcaaagccgagagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaatgaccagtacatatacatgggggaacctctcgaaaacgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctgatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacctagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcattatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgaggagagaccaaagaggcagtgggcaggtcggcacctatggcctcaatactttcaccaatatggaagcccaattaattagacagatggagggagaaggaatcttcaaaagcatccagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6843 - RNA, 9876 nt, synthetic construct
  misc_feature 1..9876: note = derived and/or modified CDS sequence (wt) from DENV-2__FJ639733__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggtattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgcaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgaggcaacaatgagaggagcaaagagaatggccattttaggtgacacagcctgggattttggatccctggggggagcgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaattatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccgcctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaagatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccactaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaaaactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccaatacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccagagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaattaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaagagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcttgtggtag

SEQ ID NO: 6844 - RNA, 9876 nt, synthetic construct
  misc_feature 1..9876: note = derived and/or modified CDS sequence (wt) from DENV-2__FJ639734__SS-prME
  source 1..9876: mol_type = other RNA
acagcaggcgtgattgttatgttgattccaacagcgatagcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatgggggaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggtaatgacacaggaaaacacggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacctggagctgacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaacagaaaaagatagcccagtcaacatagaagcagaacctccattcggagacagctacatcatcataggagtagagccgggacaactgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactatacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgctggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatctctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggcccattagtggctggagggctccttaccgtatgttacgtgctcactggacgatcggccgatttggaactggagagagctgccgaggtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggaccttcatccaggagcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaagacttttgactctgagtatgttaagactagagccaatgattgggactttgtggtcacgactgacatttcagaaatgggtgccaacttcaaagctgagagggtaatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggccagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtagctgcaaccatggcaaacgagatgggtttcctggaaaaaaccaagaaagacctcggattgggaagcattacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccatcggatgctactcacaagtcaaccctataactctcacagcagctcttcttttattggtagcacattatgccattatagggccaggactccaagcaaaagcaaccagagaagcacagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactgaagaatgtaagagaagtcaaaggcctaacaaaaggaggaccaggacacgaagaacccatccctatgtcaacatatgggtggaatttagtgcgtctgcaaagcggagttgacgttttcttcaccccgccagaaaaatgtgatacattgttgtgtgacataggggagtcgtcaccaaatcccacgatagaagcaggacgaacactcagagtcctcaacttagtagaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgaaaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggagagttcggcaaggcaaaaggcagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgcgctcgtagtcccatgcagaaaccaagatgaactgattggtagagcccgaacttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6845 - RNA, 9876 nt, synthetic construct
  misc_feature 1..9876: note = derived and/or modified CDS sequence (wt) from DENV-2__JN819408__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgcttgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaagaataaaccaacattggattttgaactgataaaaacagaagccaaacaacctgccactctaaggaagtactgtatagaagcaaagctgactaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacaccccactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagatttggagaaaagacacgtcttaggtcgcctgattacagttaacccaatcgtaacagaaaaagatagcccagtcaacatagaagcagaacctccattcggagacagctacatcatcataggagtagagccgggacaattgaaacttaattggtttaagaagggaagttccatcggccaaatgttcgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcattatcacatggataggaatgaattcacgtagcacctcactgtctgtgtcgctagtactggtgggagtcgtgacactgtacttgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagagtgccccaacacaaacagagcttggaactcgctggaagttgaagactatggtttcggagtttttaccaccaatatatggctaaaactgagagaaaaacaggatatattttgtgactcaaaactcatgtcagcggccattaaagataacagagccgttcatgccgatatgggttattggatagaaagtgcactcaatgacacatggaagatggagaaagcctccttcattgaggttaagagctgccattggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtagtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtgggaacgaaacatgcaatactgctagttgcagtatcttttgtgacattgattactgggaacatgtcttttagagacttgggaagagtgatggttatggtgggcgccaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcactataccagagaccattcttgaactgactgatgcgttagccttgggcatgatggccctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttctccactgctcttaacatcctcacagcaaaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttagaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcagaaccaacaccggaaccataggcgccgtatctctggacttttcccctggaacgtcaggatctccaattgtcgacagaaaaggaaaagtcgtgggtctttacggtaatggtgttgtcacaaggagtggagcatatgtaagtgctatagcccagaccgaaaaaagcattgaagacaatccagagatcgaagatgacatttttcgaaagaaaagattgaccatcatggacctccatccaggagcaggaaagacaaaaagataccttccagccatagttagagaagccataaaacgtggcttgagaacattgatcctggctcccactagagtcgtggcagctgaaatggaggaagctcttagaggacttccaataagataccaaaccccagccatcaaagctgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgagtagagatgggtgaagcagccgggattttcatgacagccactcctccgggaagtagagacccatttcctcagagcaatgcaccaataatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgaatatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtatatatacatgggggaacctctcgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaatcaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactacttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattataacccaggaatctgagaacaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacttagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtagatctcggttgcggcagagggggctggtcatactattgcgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacactgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattgcaaaggaaatatggaggagccttagtgaggaatccactttcacgaaactccacgcatgaaatgtactgggtatctaatgccaccgggaacatagtgtcatcagtgaacatgatttcaagaatgttgattaacagattcacaatgaaacacaagaaagccacctacgagccagatgttgacctaggaagtggaacccgcaacattggaattgagggtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacgaagaagctgatgaaaatcacggcagagtggctttggaaagaactaggaaagaaaaagacacctaggatgtgtaccagagaagaattcacaaaaaaagtgagaagcaatgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcctagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaatatggaagcccaattaattagacagatggagggagaaggaatcttcaaaagcatccagcacctgacagccacagaagaaatcgctgtacagaactggttagcaagagtggggcgtgaaaggctatcaagaatggcaatcagtggagatgactgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6846 - RNA, 9876 nt, synthetic construct
  misc_feature 1..9876: note = derived and/or modified CDS sequence (wt) from DENV-2__FJ639783__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacctacaagtgtcctctcctcagacaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggagtatcaaatagagacttcgtagaaggggtttcaggaggaagctgggttgatatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggccttgacttcaatgagatggtgctgctgcagatggaagacaaagcttggctggtgcacaggcaatggttcctagacctgccgttaccgtggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggccgcctgatcacagttaacccaatcgtaacagaaaaagatagcccagtcaacatagaagcagaacctccattcggggacagctacatcatcataggagtagagccgggacaattgaaactcaattggtttaagaagggaagttccatcggccaaatgttcgagacaacaatgagaggagcaaagagaatggctattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggctgcgttgtgagctggaaaaataaagaactgaaatgtggcagtgggatcttcatcacagacaacgtacacacatggacagaacaatataagttccaaccagaatccccttcaaaactagcttcagctatccaaaaagctcatgaagagggcatttgtggaatccgctcagtaacaagattggagaacctgatgtggaaacaaataacaccagaattgaatcatattctatcagaaaatgaagtaaagttgaccattatgacaggagacattaaaggaatcatgcaagcaggaaaacgatccttgcggccccagcccactgagctgaagtactcatggaaaacatggggaaaggcgaaaatgctctccacagaatctcacaatcagacctttcttattgatggccctgaaacagcagaatgccccaatacaaacagagcttggaactcactggaagttgaagactatggttttggagtttttaccaccaatatatggctaaaattgagagaaaaacaggatgtattttgtgactcaaaactcatgtcagcggccatcaaagacaacagagccgttcacgccgatatgggttattggatagaaagcgcactcaatgacacatggaagatggagaaagcctccttcattgaagttaaaagctgccattggccaaagtcacacaccctttggagcaatggagtattagaaagtgagatgataattccaaaaaactttgccgggccagtgtcacaacacaactacagaccaggctaccatacacaaacagcaggaccttggcatctaggtaagcttgagatggactttgatttctgcgaaggaactacggtagtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgcaaccatgacggatgacataggtatgggagtgacttatcttgccctactagcagctttcaaagttagaccaacttttgcagctggactactcttgagaaaactgacctccaaagaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactgtcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttactgtatgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaggatggagcctacagaattaagcaaagagggattcttggatattctcagattggagccggagtttacaaagaaggaacattccatacaatgtggcacgtcacacgtggtgctgtcctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacaaaacctggaattttcaaaaccaacaccggaaccataggcgccgtatctctggacttttcccctggaacgtcaggatctccaattgtcgacagaaaaggaaaggttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagccgaaatggaggaagctcttagaggacttccaataagataccaaaccccagccatcaaagccgaacacaccgggcgggagattgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaatttcaaggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgacccagaaggcaagaaacgcactggacaacttggctgtgctgcatacggctgaggcaggtggaagggcgtacaatcatgctctcagtgaactgccggagactctggagacactgcttctactgacactcctggcaacagtcacaggaggaatcttcttattcttaatgagcggaaaaggtatagggaagatgaccctgggaatgtgttgcataatcacggctagtgtcctcctatggtatgcacagatacaaccacactggatagcagcttcaataatactggagttttttctcatagttttgctcattccagagccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattataggcccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcgctggggaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatacatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcaccgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaagcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtatgccgatgatacagcaggatgggatacaagaatcacactagaagacttaaaaaatgaagaaatggtaacaaaccacatgaaaggagaacacaagaaactagctgaggccatattcaaattaacgtaccaaaataaggtggtgcgtgtgcaaagaccaacaccaagaggcacagtaatggatatcatatcgagaagagaccaaagaggcagtgggcaagtcggcacctatggccttaatactttcaccaatatggaagcccaattaatcagacagatggaaggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgttctgtggtag

SEQ ID NO: 6847 - RNA, 9876 nt, synthetic construct
  misc_feature 1..9876: note = derived and/or modified CDS sequence (wt) from DENV-2__FJ639788__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacctacaagtgtcctctcctcagacaaaatgaaccagaagacatagactgttggtgcaactctacgtccacatgggtaacttatgggacatgtaccaccgcaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggagtatcaaatagagacttcgtagaaggggtttcaggaggaagctgggttgatatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggccttgacttcaatgagatggtgctgctgcagatggaagacaaagcttggctggtgcacaggcaatggttcctagacctgccgttaccgtggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggccgcctgatcacagttaacccaatcgtaacagaaaaagatagcccagtcaacatagaagcagaacctccattcggggacagctacatcatcataggagtagagccgggacaattgaaactcaattggtttaagaagggaagttccatcggccaaatgttcgagacaacaatgagaggagcaaagagaatggctattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaacctgatgtggaaacaaataacaccagaattgaatcatattctatcagaaaatgaagtaaagttgaccattatgacaggagacattaaaggaatcatgcaagcaggaaaacgatccttgcggccccagcccactgagctgaagtactcatggaaaacatggggaaaggcgaaaatgctctccacagaatctcacaatcagacctttcttattgatggccctgaaacagcagaatgccccaatacaaacagagcttggaactcactggaagttgaagactatggttttggagtttttaccaccaatatatggctaaaattgagagaaaaacaggatgtattttgtgactcaaaactcatgtcagcggccatcaaagacaacagagccgttcacgccgatatgggttattggatagaaagcgcactcaatgacacatggaagatggagaaagcctccttcattgaagttaaaagctgccattggccaaagtcacacaccctttggagcaatggagtattagaaagtgagatgataattccaaaaaactttgccgggccagtgtcacaacacaactacagaccaggctaccatacacaaacagcaggaccttggcatctaggtaagcttgagatggactttgatttctgcgaaggaactacagtagtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgcaaccatgacggatgacataggtatgggagtgacttatcttgccctactagcagctttcaaagttagaccaacttttgcagctggactactcttgagaaaactgacctccaaagaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactgtcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttactgtatgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaggatggagcctacagaattaagcaaagagggattcttggatattctcagattggagccggagtttacaaagaaggaacattccatacaatgtggcacgtcacacgtggtgctgtcctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacaaaacctggaattttcaaaaccaacaccggaaccataggcgccgtatctctggacttttcccctggaacgtcaggatctccaattgtcgacagaaaaggaaaggttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagccgaaatggaggaagctcttagaggacttccaataagataccaaaccccagccatcaaagccgaacacaccgggcgggagattgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaatttcaaggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgccaggatctattctgacccactggcactaaaagaattcaaggaatttgcagctggaagaaaatctttgaccctgaacctaatcacagaaatgggtaggcttccaactttcatgacccagaaggcaagaaacgcactggacaacttggctgtgctgcacacggctgaggcaggtggaagggcgtacaatcatgctctcagtgaactgccggagactctggagacactgcttctactgacactcctggcaacagtcacaggaggaatcttcttattcttaatgagcggaaaaggtatagggaagatgaccctgggaatgtgttgcataatcacggctagtgtcctcctatggtatgcacagatacaaccacactggatagcagcttcaataatactggagttttttctcatagttttgctcattccagagccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattataggcccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacactaccatcgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcgctggggaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaactataacacccaattttgcataaaggtcctcaacccatacatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcaccgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaagcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggatacaagaatcacactagaagacttaaaaaatgaagaaatggtaacaaaccacatgaaaggagaacacaagaaactagctgaggccatattcaaattaacgtaccaaaataaggtggtgcgtgtgcaaagaccaacaccaagaggcacagtaatggatatcatatcgagaagagaccaaagaggcagtgggcaagtcggcacctatggccttaatactttcaccaatatggaagcccaattaatcagacagatggaaggagaaggaatctttaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactatatgccatccatgaagagattcagaagggaagaggaagaggcaggtgttctgtggtag

SEQ ID NO: 6848 - RNA, 9876 nt, synthetic construct
  misc_feature 1..9876: note = derived and/or modified CDS sequence (wt) from DENV-2__FJ639822__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacctacaagtgtcctctcctcagacaaaatgaaccagaagacatagactgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggagtatcaaatagagacttcgtagaaggggtttcaggaggaagctgggttgatatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaaacatggcaaggaaatcaaaataacaccacagagttccatcatagaagcagaactgacaggctatggcactgtcacgatggagtgctctccgagaacgggccttgacttcaatgagatggtgctgctgcagatggaagacaaagcttggctggtgcacaggcaatggttcctagacctgccgttaccgtggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgtaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggccgcctgatcacagttaacccaatcgtaacaggaaaagatagcccagtcaacatagaagcagaacctccattcggggacagctacatcatcataggagtagagccgggacaattgaaactcaattggtttaagaagggaagttccatcggccaaatgttcgagacaacaatgagaggagcaaagagaatggctattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaacctgatgtggaaacaaataacaccagaattgaatcatattctatcagaaaatgaagtaaagttgaccattatgacaggagacattaaaggaatcatgcaagcaggaaaacgatccttgcggccccagcccactgagctgaagtactcatggaaaacatggggaaaggcgaaaatgctctccacagaatctcacaatcagacctttcttattgatggccctgaaacagcagaatgccccaatacaaacagagcttggaactcactggaagttgaagactatggttttggagtttttaccaccaatatatggctaaaattgagagaaaaacaggatgtattttgtgactcaaaactcatgtcagcggccatcaaagacaacagagccgttcacgccgatatgggttattggatagaaagcgcactcaatgacacatggaagatggagaaagcctccttcattgaagttaaaagctgccattggccaaagtcacacaccctttggagcaatggagtattagaaagtgagatgataattccaaaaaactttgccgggccagtgtcacaacacaactacagaccaggctaccatacacaaacagcaggaccttggcatctaggtaagcttgagatggactttgatttctgcgaaggaactacagtagtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaattagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgcaaccatgacggatgacataggtatgggagtgacttatcttgccctactagcagctttcaaagttagaccaacttttgcagctggactactcttgagaaaactgacctccaaagaattaatgatggccaccataggaatcgcactcctttcccaaagcaccataccagagaccattcttgaactgactgatgcgttagccttgggcatgatggtcctcaaaatagtgagaaatatggaaaaataccaattggcagtgactgtcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttactgtatgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgttccttcacccccaccagtgggaaaagccgaactggaggatggagcctacagaattaagcaaagagggattcttggatattctcagattggagccggagtttacaaagaaggaacattccatacaatgtggcacgtcacacgtggtgctgtcctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacaaaacctggaattttcaaaaccaacaccggaaccataggcgccgtatctctggacttttcccctggaacgtcaggatctccaattgtcgacagaaaaggaaaggttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagccgaaatggaggaagctcttagaggacttccaataagataccaaaccccagccatcaaagccgaacacaccgggcgggagattgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaatttcaaggctgagagggttatagaccccaggcgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaagaaaaaaattaaaacccagatggttggatgctaggatctattctgacccactggcactaaaagaattcaaggaatttgcagctggaagaaaatctttggccctgaacctaatcacagaaatgggtaggcttccaactttcatgacccagaaggcaagaaacgcactggacaacttggctgtgctgcatacggctgaggcaggtggaagggcgtacaatcatgctctcagtgaactgccggagactctggagacactgcttctactgacactcctggcaacagtcacaggaggaatcttcttattcttaatgagcggaaaaggtatagggaagatgaccctgggaatgtgttgcataatcacggctagtgtcctcctatggtatgcacagatacaaccacactggatagcagcttcaataatactggagttttttctcatagttttgctcattccagagccagaaaaacagagaacaccccaagacaaccaattgacctacgttgtcatagccatcctcacagtggtggctgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattataggcccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccctagcgaccgggcccatctccacactgtgggaaggaaatccagggaggttttggaacactaccatcgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcgctggggaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacacttagagtcctcaacttagtggaaaattggttgaacaataacacccaattttgcataaaggtcctcaacccatacatgccttcagtcatagaaaaaatggaaacattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacgaagaagctgatgaaaatcacggcagagtggctttggaaagaactaggaaagaaaaagacacctaggatgtgtaccagagaagaattcacaagaaaagtgagaagcaatgcagccttgggggccatattcaccgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaagcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggatacaagaatcacactagaagatttaaaaaatgaagaaatggtaacaaaccacatgaaaggagaacacaagaaactagctgaggccatattcaaattaacgtaccaaaataaggtggtgcgtgtgcaaagaccaacaccaagaggcacagtaatggatatcatatcgagaaaagaccaaagaggtagtgggcaagtcggcacctatggccttaatactttcaccaatatggaagcccaattaatcagacagatggaaggagaaggaatctttaaaagcattcagcacctgacagccacagaagaaatcgctgtacagaactggttaacaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgttctgtggtag

SEQ ID NO: 6849 - RNA, 9876 nt, synthetic construct
  misc_feature 1..9876: note = derived and/or modified CDS sequence (wt) from DENV-2__FJ850112__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaactggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgcaagatcccttttgagataacagacttggaaaaaagacacgtcttaggtcgcctgattacagttaacccaatcgtaatagaaaaagatagcccagttaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctggggggagcgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcattacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaattatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaagatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaaaactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccagagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaattaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaagagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcttgtggtag

SEQ ID NO: 6850 - RNA, 9876 nt, synthetic construct
  misc_feature 1..9876: note = derived and/or modified CDS sequence (wt) from DENV-2__FJ850105__SS-prME
  source 1..9876: mol_type = other RNA
acagctggcgtgatcattatgttgattccaacagcgatggcgttccatttaaccacacgcaatggagaaccacatatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactttaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcctagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcattataggagcagagccgggacaattgaaactcaattggtttaagaagggaagttccatcggccaaatgttcgagacaacaatgagaggagcaaagagaatggccattttaggtgacacagcctgggactttggatccctgggaggagtgttcacatctataggaaaggctctccaccaagttttcggagcaatctatggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtatcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatatagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgattactgggaacatgtcttttagagacctgggaagagtgatggttatggtaggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacttgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggagggggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagcataaaagcaggaaatgatatagcagcttgtctcaggaaaaatggaaagaaagtgatacaactcagtaggaaaacttttgactctgagtatgttaagactagagccaatgattgggactttgtggttacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatattggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgtgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggattaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgagacatcatggcactatgatcaagaccacccatacaaaacgtgggcttaccacggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggagccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggccgcgtgcttgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6851 - RNA, 9876 nt, synthetic construct
  misc_feature 1..9876: note = derived and/or modified CDS sequence (wt) from DENV-2__FJ850106__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaatatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccattggccaaatgttcgagacaacaatgagaggagcaaagagaatggccattttaggtgacacagcctgggactttggatccctgggaggagtgttcacatctataggaaaggctctccaccaagttttcggagcaatctatggggctgcttttagtggggtctcatggaccatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccatcaaagataacagagccgttcatgccgatatgggttattggatagaaagtgcactcaatgacacatggaagatggagaaagcctccttcattgaagttaaaagctgccactggccaaagtcacacaccctctggagcaatggagtattagaaagcgagatgataattccaaaaaattttgccgggccagtgtcacaacacaactacagaccaggttaccatacacaaacagcaggaccttggcatctaggcaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaacactgctagttgcagcatcttttgtaacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttttaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagaccaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatactctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggactttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccattggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggaatcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattgcaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccatagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6852 - RNA, 9876 nt, synthetic construct
  misc_feature 1..9876: note = derived and/or modified CDS sequence (wt) from DENV-2__FJ850107__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaactgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggagggagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcagactgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagtcaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggactttggatccctgggaggagtgttcacatctataggaaaggctctccaccaagttttcggagcaatctacggggctgcttttagtggggtctcatggaccatgaaaatcctcataggagtcgtcatcacatggataggaatgaattcacgcagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaaaagctcacgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggctttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgtgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtaacattgatcactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttggccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttttccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatactctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaacccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacattaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaagcttccaactttcatgactcagaaagcaagaaacgcactggacaacttggctgtgctgcatacggctgaggcaggtggaagggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcttggaaaaaaccaagaaagacctcggattgggaagcatcacaacccaggaatctgagagcaacatcctagacatagatctacgccctgcatcagcatggacgctgtatgccgtggccacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataagacaagagcatgaaacatcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagttgatgagaatcacggcagagtggctttggaaagaactaggaaagaaaaagacccctagaatgtgtaccagagaagaattcacaagaaaagtgagaagcaatgcagccttgggggccatattcactgatgagaacaaatggaaatcggcacgcgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgatatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattaattgggctaacaagcagggctacctgggcgaagaacatccagacagcaataaatcaagtcagatcccttataggcaatgaggaatacacagactacatgccatccatgaagagattcagaagggaagaggaagaggcaggcgtcctgtggtag

SEQ ID NO: 6853 - RNA, 9876 nt, synthetic construct
  misc_feature 1..9876: note = derived and/or modified CDS sequence (wt) from DENV-2__FJ850108__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagacacaatcacgtacaagtgtcctctcctcagacaaaatgaaccagaggacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtggaaggggtttcaggaggaagctgggttgacatagtcttagaacatggaagttgtgtgacgacgatggcaaaaaacaaaccaacattggattttgaactgataaaaacagaagccaaacaacctgccactctgaggaagtactgtatagaagcaaagctgaccaacacaacgacagaatcgcgttgcccaacacaaggggagcccagcctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcaaccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacttgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatcttaagtgcagactgagaatggacaaactacagctcaaaggaatgtcatactctatgtgtacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtaggagtcgtgacactgtacctgggagctatggtgcaggctgatagtggctgcgttgtgagctggaaaaataaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattttatcagaaaatgaggtgaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaagttgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccacacacaaatagcaggaccttggcatctaggtaagcttgagatggactttgatttctgcgaaggaactacagtggtggtgactgaggactgtggaaatagaggaccctctttaagaacaaccactgcctctggaaaactcataacagaatggtgctgccgatcctgcacactaccacccctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagaatgatggttatggtgggcgctaccatgacggatgacataggtatgggagtgacttatcttgccctactagcagctttcaaagttagaccaacttttgtagctggactactcttgagaaaactgacctccaaggaattaatgatggctaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttacgtgctcactggacgatcggcagatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagctatcaaagctgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcagggaatgatatagcagcttgtctcaggaaaaatggaaagaaagtgatacaactcagtaggaaaacttttgactctgagtatgttaagaccagagccaatgattgggactttgtggtcacgactgacatttcagaaatgggtgccaacttcaaagctgagagggttatagaccccagacgttgcatgaaaccagttatactaacagatggcgaagagcgggtgattttggcaggacctatgccagtgacccactctagtgcagcgcaaagaagagggagaataggaagaaatccaaaaaatgaaaacgaccagtacatatacatgggggaacctctcgaaaatgatgaagactgtgcacattggaaagaagctaaaatgctcctagacaacatcaacacacccgaaggaatcattcccagtatgttcgagccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtataatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagagaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaacctgagagcaacatcctagacatagatctacgccctgcatcagcatggacgctgtatgccgtggctacaacatttgtcacaccaatgttgagacatagcattgaaaattcctcagtgaatgtctctctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagttgatggaataacagtgattgacctagaaccaataccctatgatccaaaatttgaaaagcagttaggacaagtaatgctcctaatcctatgcgtgactcaagtattaatgatgagaactacatgggctttgtgtgaggctctaaccttagcgaccgggcctatctccacactgtgggaaggaaatccagggaggttttggaacactaccattgcagtgtcaatggctaacatctttagagggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaattccacgcatgaaatgtactgggtatctaatgccaccggaaacatagtgtcatcagtgaatatgatttcaaggatgttgattaacagattcacaatgaaacacaagaaagccacctacgagccagatgttgacttaggaagtggaacccgcaacattggaattgaaagtgagataccaaatctagacataataggaaagagaatagagaaaataaaacaagagcatgaaacatcatggcactatgatcaagaccacccatacaaaacgtgggcttaccacggcagctatgaaacaaaacaaactggatcagcatcatctatggtgaacggagtggtcagactgctgacaaaaccttgggacgtcgtccctatggtgacacagatggcaatgacagacacgactccattcggacaacagcgcgtttttaaagagaaagtagacacgagaacccaagaaccgaaagaaggcacaaagaagttgatgagaatcacggcagagtggctttggaaagaactaggaaagaaaaagacccctagaatgtgtaccagagaagaattcacaagaaaagtgagaagcaacgcagccttgggggccatattcactgatgagaacaaatggaaatcggcacgtgaggctgttgaagatggtaggttttgggagttggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaggatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggcctcaataccttcactaatatggaagcccaattaattagacagatggagggagaaggaatcttcaaaagcattcagcacctgacagtcacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccactttcatgagttagtcatgaaagatggtcgcgtgctcgtagtcccatgcagaaaccaagatgaactgattggtagagcccgaatttcccagggagccgggtggtctttgaaggaaacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacctgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6854 - RNA, 9876 nt, synthetic construct
  misc_feature 1..9876: note = derived and/or modified CDS sequence (wt) from DENV-2__JN819407__SS-prME
  source 1..9876: mol_type = other RNA
acagcaggcgtgatcgttatgttgattccaacagcgatggcgttccatttaaccacacgcaatggagaaccacacatgatcgttggtaggcaggagaaagggaaaagtcttctgttcaaaacagaggatggtgtcaacatgtgtaccctcatggccatagaccttggtgaattgtgtgaagacacaatcacgtacaagtgtcctctcctcagacaaaatgaaccagaggacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacgatgcgctgtataggaatatcaaatagagacttcgtggaaggggtttcaggaggaagctgggttgacatagtcttagaacatggaagttgtgtgacgacgatggcaaaaaacaaaccaacattggattttgaactgataaaaacagaagccaaacaacctgccactctgaggaagtactgtatagaagctaagctgaccaacacaacgacagaatcgcgttgcccaacacaaggggagcccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccgagaacgggcctcgacttcaatgagatggtgctgctgcagatggaagacaaagcttggctggtgcacaggcaatggttcctagacttgccattaccatggctacctggagcggatacacaaggatctaattggatacagaaagagacattggtcactttcaaaaatccccacgcgaagaaacaggatgtcgttgtcttagggtctcaagaaggggccatgcacacggcactcacaggggccacagaaatccagatgtcattaggaaacttactgttcacaggacatctcaagtgcagactgagaatggacaaactacagctcaaaggaatgtcatactctatgtgcacaggaaagtttaaaattgtgaaagaaatagcagaaacacaacatggaacaatagttatcagagtacaatatgaaggggacggttctccatgtaagatcccttttgagataacagacttggaaaaaagacacgtcttaggtcgcctgattacagttaacccaatcgtaatagaaaaagacagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggctgcgttgtgagctggaaaaataaagaactgaaatgtggtagcgggatcttcatcacagataacgtacacacatggacagaacaatataagttccaaccagaatccccctcaaaactagcttcagctatccaaaaagctcatgaagagggcatttgtggaatccgctcagtaacaagattggagaatctgatgtggaaacaaataacaccagaattgaatcatattctatcagaaaatgaggtgaagttgaccattatgacaggagacactaaaggaatcatgcaggcaggaaaacgatccttgcggccccagcccactgaactgaagtactcatggaaaacatggggaaaggcgaaaatgctcttcacagagtctcacaatcagacctttctcattgatggccctgaaacagcagaatgccccaacacaaatagagcttggaactcgttggaagttgaagactatggttttggagttttttccaccaatatatggctaaaattgagagaaaaacaggatgtattttgtgactcaaaactcatgtcagcggccattaaagacaacagagccgttcatgccgatatgggttattggatagaaagcgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttatcatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacccctaagatacagaggtgaggatggatgctggtacgggatggaaatcagaccattgaaagagaaagaggagaatttggtcaactctttggtcacagccggacatgggcagattgacaacttttcactaggagttttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggattactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaaaaatgatattcccatgacaggcccattagtggctggagggcttcttaccgtatgttatgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccgatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagctatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaacgaccagtatatatacatgggggaacccctcgaaaatgatgaagactgtgcacattggaaagaagctaaaatgctcctggacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagagaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaacctgagagcaacatcctggacatagatctacgccctgcatcagcatggacgctgtatgccgtggctacaacatttgtcacaccaatgttgagacatagcattgaaaattcttcagtgaatgtctctcttacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagttgatggaataacagtgattgacctagaaccaataccctatgatccaaaatttgaaaagcagttaggacaagtaatgctcctaatcctatgcgtgactcaagtattaatgatgaggactacatgggctttgtgtgaggctctaaccttagcaaccgggcctatctccacactgtgggaaggaaatccggggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaagaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatctcggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatacatgccctcagtcatagaaaaaatggaaacattacaaaggaaatatggaggagccttagtgaggaatccactctcacgaaactccacgcatgaaatgtactgggtatctaatgccaccggaaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacatcatggcactatgatcaagaccacccatacaaaacgtgggcttaccacggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaggtggacacgagaacccaagaaccgaaagaaggcacaaagaagctgatgagaatcacggcagagtggctttggaaagaactaggaaagaaaaagacccctagaatgtgtaccagagaagaattcacaagaaaagtgagaagcaacgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggcctcaataccttcactaatatggaggcccaattaattagacagatggagggagaaggaatcttcaaaagcattcagcacctgacagtcacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccactttcatgagttagtcatgaaagatggtcgcgtgctcgtagtcccatgcagaaaccaagatgaactgattggtagagcccggatttcccagggagccgggtggtctttgaaggaaacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacctgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6855 - RNA, 9876 nt, synthetic construct
  misc_feature 1..9876: note = derived and/or modified CDS sequence (wt) from DENV-2__FJ898465__SS-prME
  source 1..9876: mol_type = other RNA
acagcaggcgtgattattatgttaattccaacagcaatggcgttccatttaaccacacgtaatggagaaccacacatgatcgttggtaggcaagagaaaggaaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactccacgtccacatgggtaacatatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaaaggccttgatttttattttactgacagctgtcgctccttcaatgacaatgcgttgtataggaatatcaaatagagacttcgtagaaggggtttcaggaggaagctgggttgacatagtcttagaacatggaagttgtgtgacgacgatggcaaagaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgctgccagaaaatctggaatacaccatcgtgataacacctcactcaggagaagagcacgccgtaggcaatgacacaggaaaacatggcaaggaaatcaaaataacaccacagagttccatcacagaagcagaactgacaggctatggcactgtcacgatggagtgctctccgagaacgggtctcgacttcaatgagatggtgctgctgcagatggaagagaaagcttggctggtgcacaggcaatggttcctagacctgccgctaccatggctacccggagcggacacacaaggatcaaattggatacaaaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgagggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggctattttaggtgacacagcctgggattttggatccctaggaggagtgtttacatctataggaaaggctctccaccaagtctttggagcaatctatggggctgcttttagtggggtctcatggactatgaaaatcctcataggagtcatcatcacatggataggaatgaattcacgaagcacctcactgtctgtgtcactagtattggtgggagtcgtgacactgtatctgggagctatggtgcaggctgatagtggttgcgttgtgagctggaaaaacaaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccatcatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcggaatgccccaacacaaacagagcttggaactcgctggaagttgaagactatggttttggagttttttccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacataccctctggagcaatggagtattggaaagtgaaatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggacggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatgctgctagttgcagtatcttttgtgacattgattactgggaacatgtcctttagagacctgggaagagtgatggttatggtgggcgctaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgaggaatatggaaaactaccaattggcagtgactatcatggctatctcgtgtgtcccaaatgcagtgatactgctaaacgcatggaaggtgagttgcacaatactggcagcggtgtccgtttctccattgcttttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcatcttagccagttctctcctaaagaatgacattcccatgacaggtccattagtggctggagggctccttaccgtgtgttacgtgctcactggacgatcggccgatttggaactggagagagctgccgatgtaaaatgggaagatcacgcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaagaaacaacgggctggagtattgtgggacgttccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagttagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagctataaaacgtggcttgagaacgttaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccgtttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcccagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgtttcgatggaattaagaacaaccaaatactggaagaaaacgtggaagtggaaatctggacgaaagaaggggaaaggaagaaattaaaacccagatggttggatgctaggatctattctgacccactggcactaaaagaattcaaggagtttgcagctggaagaaaatctttgaccctgaacctaatcacagaaatgggtaggcttccaactttcatgactcagaaggcaagagacgcactggacaacttagctgtgctgcatacggctgaggcaggtgggagggcgtacaatcatgctctcagtgaactgccggagaccctggagacactgcttttgctgacactcctggccacagtcacaggaggaatcttcttattcttaatgagcggaaaaggtatagggaagatgaccctgggaatgtgttgcataatcacggctagtatcctcttatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggatatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcggtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaacatggtcacaccagaagggaaggtggtggacctcggttgtggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttatgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccggaaacatagtgtcatcagtgaacatgatctcaaggatgttgattaacagattcacaatgaaacacaagaaagccacttacgagccagatgttgacctaggaagcggaacccgcaacattggaattgaaagtgagataccaaatctagacataataggaaaaagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagatacgactccttttggacaacaacgcgttttcaaagagaaagtggacacgagaacccaagaaccgaaggagggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctgggctacattttaagagacgtgagcaagaaagaagggggagcaatgtacgccgatgatacagcaggatgggacacaagaatcacactagaagacttaaaaaatgaagaaatggtaacaaaccacatgaaaggagaacacaagaaactagccgaggccatatttaaattaacgtaccaaaacaaggtggtgcgtgtgcaaagaccaacaccaagaggcacagtaatggatatcatatcgagaagagaccaaagaggcagcgggcaagttggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagccctaaatgacatggggaaagttaggaaagatatacaacaatgggaaccttcaagaggatggaacgactggacacaagtgcctttctgttcacaccattttcatgagttagtcatgaaagatggtcgcgtgctcgtagtcccatgcagaaatcaagatgaactgattggcagagcccgaatttcccagggagccgggtggtctctgaaggagacggcctgtttgggaaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtatggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6856 - RNA, 9876 nt, synthetic construct
  misc_feature 1..9876: note = derived and/or modified CDS sequence (wt) from DENV-2__FJ898466__SS-prME
  source 1..9876: mol_type = other RNA
acagcaggcgtgattgttatgttgattccaacagcgatggcgttccatttaaccacacgcaatggagaaccacacatgattgttggtaggcaggagaaagggaaaagtcttctgttcaaaacagaggatggtgttaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaagaataaaccaacattggattttgaactgataaaaacagaagccaaacaacctgccactctaaggaagtactgtatagaagcaaagctgactaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcaaccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagagtacaatatgaaggggatggttctccatgtaagatcccttttgagataacagatttggagaaaagacacgtcttaggtcgcctgattacagttaacccaatcgtaacagaaaaagatagcccagtcaacatagaagcagaacctccattcggagacagctacatcatcataggagtagagccgggacaattgaaacttaattggtttaagaagggaagttccatcggccaaatgttcgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtactggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctatccaaagagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagagtgccccaacacaaacagagcttggaactcgctggaagttgaagactatggttttggagtttttaccaccaacatatggctaaaactgagagaaaaacaggatatattttgtgactcaaaactcatgtcagcggccattaaagataacagagcagttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtgggaacgaaacatgcaatactgctagttgcagtatcttttgtgacattgattactgggaacatgtcttttagagacttgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggccctcaaaatagtgagaaatatggaaaaataccaattggcagtgactatcatggctatttcgtgtgtcccaaatgcagtgatactgcaaaacgcatggaaggtgagttgcacaatattggcagcggtgtccgtctctccactgctcttaacatcctcacagcaaaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggccggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacccggaattttcagaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagtaagagaagccataaaacgtggcttgagaacattaatcctggctcccactagagtcgtggcagctgaaatggaggaagctcttagaggacttccaataagataccaaaccccagccatcaaagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgacatagcagcttgtcttaggaaaaatggaaagaaagtgatacaactcagtaggaagacttttgactctgaatatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaacccaaaaaatgaaaatgaccagtatatatacatgggggaacctctcgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaatcaagaacaaccaaatactggaagaaaatgtggaagtggaaatctggacaaaagaaggggaaagaaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggcaggtggaagggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgccctgcatcagcatggacgctgtatgccgtggctacaacatttatcacaccaatgttgagacatagcattgaaaattcctcagtgaatgtctccctaacagccattgccaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagcccagaaaagagcagcagcaggcatcatgaaaaacccaacagtcgatggaataacagtgattgacttagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggactcctcttttccatcatgaaaaacacaacaaacacaagaagaggaactggcaacataggagagacacttggagaaaaatggaaaagtcgattaaacgcactgggaaaaagtgaatttcagatctacaagaaaagtggaatccaggaagtggatagaaccctagcaaaagaaggcatcaaaagaggagaaacggaccaccatgctgtgtcgcgaggttcagcaaaactgagatggttcgtcgagagaaatatggtcacaccggaagggaaggtggtagatctcggttgcggtagggggggctggtcatactattgcgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgcgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaaacattgcaaaggaaatatggaggagccttagtgaggaatccactttcacgaaactccacgcatgaaatgtactgggtatctaatgccaccgggaacatagtgtcatcagtaaacatgatttcaaggatgttgattaacagattcacaatgaaacacaagaaagccacctacgagccagatgttgacctaggaagtggaacccgcaacattggaattgagagtgagataccaaatctagacataataggaaagagaatagagaaaataaaacaagagcatgaaacatcatggcactatgatcaagaccacccatacaaaacgtgggcttaccatggcagctatgaaacaaaacaaactggatcagcatcatctatggtgaacggagtagtcagactgctgacaaaaccttgggacgtcgtccctatggtgacacagatggcaatgacagacacgactccatttggacaacagcgcgttttcaaagagaaagtagacacgagaacccaagaaccgaaggaaggcacgaagaagctgatgaaaatcacggcagagtggctttggaaagaactaggaaagagaaagacacctaggatgtgtaccagagaagagttcacaaaaaaagtgagaagcaatgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtgacaaaccacatgaaaggagaacacaagaaactagccgaggccatattcaaattaacgtaccaaaacaaggtggtgcgtgtgcaaagaccaacaccaagaggcacagtaatggatatcatatcaagaagggaccaaagaggcagtgggcaagtcggcacctatggccttaatactttcaccaacatggaagcccaattaattagacagatggagggagaaggaatcttcaaaagcattcagcacctgacagccacagaagaaatcgctgtacagaactggctagcaagagtggggcgtgaaaggctatcaagaatggcaatcagtggagatgactgtgttgtaaaacctatagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaagccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgctatttgctcggcagtcccgtcacattgggttccaacaagtcgaacaacctggtccatacacgccaagcatgaatggatgacgacagaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6857 - RNA, 9876 nt, synthetic construct
  misc_feature 1..9876: note = derived and/or modified CDS sequence (wt) from DENV-2__FJ898467__SS-prME
  source 1..9876: mol_type = other RNA
acagcaggcgtgatcattatgttgattccaacagcgatggcgttccatttaaccacacgcaatggagaaccacacatgatcgttggtaggcaggagaaagggaaaagtcttctgttcaaaacagaggatggtgttaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttcctcacgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccctcaatgacaatgcgctgcataggaatatcaaatagagacttcgtggaaggggtttcaggaggaagctgggttgacatagtcttagaacatggaagttgtgtgacgacgatggcgaaaaacaaaccaacattggattttgaactgataaaaacagaagccaaacaacctgccactctaaggaagtactgtatagaagcaaagctgaccaacacaacgacagaatcgcgttgcccaacacaaggggaacccagtctaaacgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtgggcaatgacacaggaaaacacggcaaggaaatcaaaataacaccacagagttccatcacagaagcagaactgacaggctatggcactgttacgatggagtgctctccaagaacgggcctcgacttcaatgagatggtgctgctgcagatggaagacaaagcttggctggtgcacaggcaatggttcctagacctgccattaccatggctacctggagcggacacacaaggatcaaattggatacagaaagagacattggtcactttcaaaaatccccacgcgaagaaacaggatgtcgttgtcttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaagaaatagcagaaacacaacatggaacaatagttatcagaatacaatatgaaggggacggttctccatgtaagatcccttttgagataacagacttggaaaaaagacacgtcttaggtcgcctgattacagttaacccaatcgtaatagaaaaagatagcccagtcaacatagaagcagaacctccattcggagacagctacatcatcataggagtagagccgggacaattgaaactcaattggtttaagaagggaagttccatcggccaaatgttcgagacaacaatgagaggagcaaagagaatggccattttaggtgacacagcctgggactttggatccctgggaggagtgttcacatctataggaaaggctctccaccaagttttcggagcaatctatggggctgcttttagtggggtctcatggactatgaaaatcctcataggagtcgtcatcacatggataggaatgaattcacgtagcacctcactgtctgtgtcgctagtattggtgggagtcgtgacactgtacctgggagctatggtgcaggctgatagtggttgcgttgtgagctggaaaaataaagaactgaaatgtggcagcgggatcttcatcacagataacgtacacacatggacagaacaatataagttccaaccagaatccccttcaaaactagcttcagctattcaaaaagctcatgaagagggcatttgtggaatccgctcagtaacaagattggagaatctgatgtggaaacaaataacaccagaattgaatcatattctatcagaaaatgaggtaaagttgaccattatgacaggagacactaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaatagagcttggaactcgttggaagttgaagactatggttttggagtttttaccaccaatatatggctaaaattgagagaaaaacaggatgtattttgtgactcaaaactcatgtcagcggccattaaagacaacagagccgttcatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggttaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccctggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcacactcctttcccaaagcaccataccagagaccattcttgaactgactgatgcgttagccttgggcatgatggtcctcaaaatagtgagaaatatggaaaaataccaattggcagtgactattatggctatttcgtgtgtcccaaatgcagtgatactgcgaaacgcatggaaggtgagttgcacgatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcatattagccagttctctcctaaaaaatgatattcccatgacaggcccattagtggctggagggcttcttaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaggatggagcctacagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagttagaaggagaatggaaggaaggagaggaagtccaagtcctggcattggaacctggaaaaaatccaagagccgtccaaacgaaacctggaattttcaaaaccaacaccggaaccataggcgccgtgtctctggacttttcccctggaacgtcaggatctccaattgtcgacagaaagggaaaagttgtgggtctttacggtaatggtgttgtcacaaggagtggagcatatgtaagtgctatagcccagaccgaaaaaagcattgaagacaatccagagatcgaagatgacattttccggaaaaaaagattgaccatcatggacctccatccaggagcaggaaagacaaaaagataccttccagccatagtcagagaagccataaaacgtggcttgagaacattaattctggctcccactagagtcgtggcagctgaaatggaggaagctcttagaggactcccaataagataccaaaccccagccatcaaagccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaatccctgagcgttcgtggaattcaggacatgaatgggtcacggattttaaggggaagactgtttggtttgttccaagtataaaagcaggaaatgatatagcagcttgtctcaggaaaaatggaaagaaagtgatacaactcagtaggaaaacttttgactctgagtatgttaagactagagccaatgattgggactttgtggtcacgactgacatttcagaaatgggtgccaacttcaaagctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacattggaaagaagctaaaatgctcctagacaacatcaacacacccgaaggaatcattcccagtatgttcgaaccagagcgtgaaaaagtggatgccattgatggtgaataccgtttgagaggagaagcaaggaaaacctttgtggacctaatgagaagaggggacttaccagtctggttggcttacaaagtggcagctgaaggcatcaactacgcagacagaaagtggtgttttgatggaattaagaacaaccaaatactggaagaaaatgtggaagtggaaatctggacaaaagaaggggaaaggaaaaaactaaaacccagatggttggatgctaggatctattctgacccactggcactaaaagaattcaaggaatttgcagctggaagaaaatctttgaccctgaacctaatcacagaaatgggcaggcttccaactttcatgactcagaaagcaagaaacgcactggacaacttggctgtgctgcatacggctgaggcaggtggaaaggcgtacaatcatgctctcagtgaactgccggagaccctggagacactgcttctattgacactcctggcaacagtcacaggaggaatcttcctattcttaatgagcggaaaaggtatagggaagatgaccctgggaatgtgttgcataatcacggctagtgtcctcctatggtatgcacagatacaaccacactggatagcagcttcaataatactggagttttttctcatagtcttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcatcacaacccaggaatctgagagcaacatcctagacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggactccaagcaaaagcaaccagagaagctcagaaaagagcagcagcaggcatcatgaaaaacccaacagtcgatggaataacagtgattgacctagaaccaataccctatgatccaaaatttgaaaagcagttgggacaagtaatgctcctaatcctatgcgtgactcaagtattaatgatgaggactacatgggctttgtgtgaggctttaaccttagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactggggaaaagtgaatttcagatctacaaaaaaagtggaatccaggaagtagatagaaccctagcaaaagaaggcatcaaaagaggagaaacggaccaccatgctgtgtcgcgaggttcagcaaaactgagatggttcgtcgagagaaatatggtcacaccggaggggaaggtggtggatcttggttgcggcagagggggctggtcatactattgtgggggactaaagaatgtaagagaagtcaaaggtctaacaaaaggaggaccaggacacgaagaacccatccctatgtcaacatatgggtggaatctagtgcgtctgcaaagcggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaacccatatatgccctcagtcatagaaaaaatggaaacattacaaaggaaatatggaggagccttagtgaggaatccactctcacgaaactccacgcatgaaatgtactgggtatctaatgccaccgggaacatagtgtcatcagtgaatatgatttcaaggatgttgattaacagattcacaatgaaacacaagaaagccacctacgagccagatgttgacctaggaagtggaacccgcaacattggaattgaaagtgagataccaaatctagacataataggaaagagaatagagaaaataaaacaagagcatgaaacgtcatggcactatgatcaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtttttaaagagaaagtagacacgagaacccaagaaccgaaagaaggcacaaagaagctgatgagaatcacggcagagtggctttggaaagaactaggaaaaaaaaagacccctagaatgtgtaccagagaagaattcacaagaaaagtgagaagcaatgcagccttgggggccatattcactgatgagaacaaatggaaatcggcacgtgaggctgttgaagatggtaggttttgggagctggttgacaaggaaagaaatctccatcttgaaggaaagtgtgaaacatgtgtgtacaacatgatgggaaaaagagagaagaaactaggggagttcggcaaggcaaaaggcagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggcctcaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggagatgattgtgttgtaaaacctatagatgacagatttgcaagtgctttaacagctctaaatgacatgggaaaagttaggaaagatatacaacaatgggaaccttcaagaggatggaatgattggacacaagtgcctttctgttcacaccattttcatgagttagtcatgaaagatggccgcgtgctcgtagtcccatgcagaaaccaagatgaactgattggtagagcccgaatttcccagggagccgggtggtctttgaaagagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggattcaagaaaacccgtggatggaagacaaaactccagtggaatcatgggaagaagtcccatacttgggaaaaagagaagaccaatggtgcggctcattgattgggctaacaagcagggctacctgggcgaagaacatccagacagcaataaatcaagtcagatcccttataggcaatgaggaatacacagactacatgccatccatgaagagattcagaagggaagaggaagaggcaggtgtcctgtggtag

SEQ ID NO: 6858 - RNA, 9876 nt, synthetic construct
  misc_feature 1..9876: note = derived and/or modified CDS sequence (wt) from DENV-2__GQ868595__SS-prME
  source 1..9876: mol_type = other RNA
acagcaggcgtgattattatgttgattccaacagcaatggcgttccatttaaccacacgcaatggagaaccacacatgatcgttagtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgatatagtcttagaacatggaagttgtgtgacgacgatggcaaaaaataaaccaacattggatttcgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtaacctgtgctatgtttacatgcaaaaagaacatggaaggaaaagtcgtgctgccagaaaatctggaatacaccatcgtgataacacctcactcaggagaagagcacgctgtaggtaatgacacaggaaaacatggcaaggaaatcaaaataacaccacagagttctatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccattaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaaatttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccaggacaattgaaactcaattggtttaagaagggaagttccatcggccaaatgtttgagacaacaatgagaggagcgaaaagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaacaaagaactgaaatgtggcagcgggatcttcattacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggcctcagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtctttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccacacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatctggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttaccttgccctactagcagcttttaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgttccaaatgcagtgatactgctaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcatgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccgggagcaggaaagacaaaaagataccttccagctatagttagagaagctataaaacgtggcttgagaacattaatcctggctcccactagagttgtggcagctgaaatggaggaagctcttagaggactcccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgctaacttcagggctgagagggttatagaccccagacgttgcatgaaaccagtcatactaacagatggcgaagagcgggtgatcttggcgggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgagggaatcattcccagtatgttcgaaccagagcgtgaaaaggtggatgccattgatggtgaataccgtttgagaggagaagcaaggaaaacctttgtggacctaatgagaagaggagacttaccagtctggttggcctatagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataattacggctagtatcctcctatggtatgcacagatacaaccacactggatagcagcttcaataatactggagtttttcctcatagttttgctcattccagaaccagaaaaacagagaacaccccaagacaaccaattgacctatgtagtcatagccatcctcacagtggtggccgcaaccatggcaaatgagatgggtttcctggaaaaaaccaagaaagacctcggattgggaagcattacaacccaggaatctgagagcaacatcctggacatagacctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcaaaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccagttttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctgggaagcggaacccgcaacattggaattgaaagtgagataccaaatctagacataataggaaaaagaatagagaaaataaagcaagagcatgaaacatcatggcactatgaccaagaccacccatacaaaacgtgggcttaccatggcagctatgaaacaaagcaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaagctaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgctgatgatacagcaggatgggacacaagaatcacactagaagacttaaaaaatgaagaaatggtaacaaaccacatgagaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattaagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgaccttagactggcggcaaatgccatttgctcggcagtcccgtcacactgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggctcattgattgggctaacaagcagggccacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6859 - RNA, 9876 nt, synthetic construct
  misc_feature 1..9876: note = derived and/or modified CDS sequence (wt) from DENV-2__GQ868540__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggtcgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgtttacatgcaagaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcctggctggtgcacaggcaatggttcctagatctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagacagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaacaaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttgttgatggccctgaaacagcagaatgtcccaacacaaacagagcttggaactcgctggaagttgaagactatggttttggagtttttaccaccaatatatggctaaaactgagagaaaaacaagatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactggaaacatgtcctttagagacctgggaagagtgatggttatggtgggcgctaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatactgctaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggctgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatacttatcagaacgggattgctggtgatctcaggagtctttccagtatcgataccaatcacggcagcagcatggtacctgtgggaagtgaagaaacaacgggctggagtattgtgggacgttccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcctactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagagctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacatggaagtggaaatctggacaaaagaaggggaaaggaagaaattaaaacccagatggttggatgctaggatctattctgacccactggcactaaaagaatttaaggaatttgcagctggaagaaaatctctgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctatgtagtcatagctatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgctgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaactagagaagctcagaaaagagcagcagcaggcatcatgaaaaacccaacagttgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaatacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacgctacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatggggaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggatacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgcttgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacatgctaagcatgaatggatgacgacggaagacatgctggcagtctggaatagggtgtggatccaagaaaacccgtggatggaagacaaaactccagtggaatcatgggaagaaatcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6860 - RNA, 9876 nt, synthetic construct
  misc_feature 1..9876: note = derived and/or modified CDS sequence (wt) from DENV-2__GQ868541__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagacacaatcacgtacaagtgtcccctcctcaggcaaaatgaaccagaagacatagattgttggtgcaactctacgtccacatgggtaacttatgggacatgtactaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaacaaaccaacactggattttgaactgataaaaacagaagccaaacaacctgccactctaaggaagtactgtatagaagcaaagctgaccaatacaacaacagaatctcgttgcccaacacaaggggaacccagtctaaatgaagagcaggacaagaggttcatttgcaaacactccatggtagacagaggatggggaaatggatgtggattatttggaaaaggaggcattgtgacctgtgctatgtttacatgcaaaaagaacatggaaggaaaagtcgtgctgccagaaaatctggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcacttttaaaaatcctcacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactgcagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagtcaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtactggtgggagtcgtgacactgtacctgggagctatggtgcaggctgacagtggttgcgttgtgagctggaaaaacaaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatccttgcggccccagcccactgagctgaagtactcatggaaaacatggggaaaggcgaaaatgctttccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagtaatggagtattggaaagtgagatgataattccaaaaaattttgccggaccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaactcataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagagatgctcaggacccgagtaggaacgaaacatgcaatactgctagttgcagtatcttttgtgacattgattactgggaacatgtcctttagagacctgggaagagtgatggttatggtgggcgctaccatgacggatgacataggtatgggagtgacttaccttgccctactagcagctttcaaagttagaccaactttcgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggcagtgactatcatggctatctcgtgtgtcccaaatgcagtgatactgctaaacgcatggaaggtgagttgcacaatattggcagcggtatccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagccgccgatgtaaaatgggaagatcacgcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagttggaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttatggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgccttagaaaaaatggaaagaaagtgatacaactcagtaggaagacttttgactctgagtatgttaagactagagccaatgattgggattttgtggtcacaactgacatttcagaaatgggtgccaacttcagggctgagagggttatagaccccagacgttgcatgaaaccagtcatactaacagatggcgaagagcgggtgatcttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgtttgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacgaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtagtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaatcaagccacagtgctaatgggtcttggaaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacctggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgcgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagacgttgacctaggaagcggaacccgcaacattggaattgaaagtgagataccaaatctagacataataggaaagagaatagagaaaataaagcaagagcatgaaacatcatggcaccatgaccaagaccacccatacaaaacgtgggcttaccatggcagctatgaaacaaaacaaactggatcagcatcatctatggtaaacggagtggtcagactgctgacaaaaccttgggacgtcgtccctatggtgacacagatggcaatgacagacacgactccttttggacaacaacgcgttttcaaagagaaagtggacacgagaacccaagaaccgaaggaaggcacaaagaaactgatgagaattacggcagagtggctttggaaagaactaggaaagaaaaagacacctaggatgtgtaccagagaagaatttacaagaaaggtgagaagcaatgcagccttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaggtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagccctaaatgacatgggaaaagttaggaaagatatacaacaatgggaaccttcaagaggatggaacgactggactcaagtgcctttctgttcacaccattttcatgagttagtcatgaaagatggtcgcgtgctcgtagtcccatgcagaaaccaagatgaactgattggcagagcccgaatttcccaaggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatctcttataggcaatgaggaatacacagactacatgccatccatgaagagattcagaagggaagaggaagaggcaggtgtcctgtggtag

SEQ ID NO: 6861 - RNA, 9876 nt, synthetic construct
  misc_feature 1..9876: note = derived and/or modified CDS sequence (wt) from DENV-2__GQ868603__SS-prME
  source 1..9876: mol_type = other RNA
acagcaggcgtgattattatgttgattccaacagcgatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagacacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcctctgcaaacactccatggtagacagaggatggggaaatggatgtggattatttggaaagggaggcattgtgacctgtgctatgtttacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggacttggaaaaaagacacgtcttaggtcgcctgattacagttaacccaatcgtaacagaaaaagatagcccagtcaacatagaagcagaacctccattcggagatagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaattatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaacatatggctaaaattgagagaaaaacaggatgtactttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagctgcagtatcttttgtgacattgataactgggaacatgtcctttagagacctgggaagagtgatggttatggtgggcgctaccatgacggatgacataggtatgggagtgacttatcttgccctactagcagctttcaaagttagaccaacttttgcagctggactactcttgagaaaactgacctccaaggaattaatgatggccaccataggaatcgcactcctttcccaaagcaccataccagagaccattcttgaactgactgatgcgttagccttgggcatgatggtcctcaaaatagtgagaaatatggaaaagtaccaattggtagtgactatcatggctatctcgtgtgtcccaaatgcagtgatattgcaaaacgcatggaaggtgagttgcacaatattggcagcggtgtccgtttctccactgctcttaacatcctcacggcagaaggcggattggataccactggcattgacgataaaaggtctcaatccaacagccatttttctaacaactctctcgagaaccagcaagaaaaggagctggccgctaaatgaagctatcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatactctcagattggagccggagtttacaaagaaggaacattccatacaatgtggcacgtcacacgtggtgctgttctgatgcatagggggaagaggattgaaccatcatgggcagacgtcaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggtgccgtatctctggacttttcccctggaacgtcaggatctccaattgtcgacagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcattatggacgaagcccacttcacagacccagcaagtatagcagcgagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagcatgttcgaaccagagcgtgaaaaggtggatgccattgatggtgaataccgtttgagaggagaagcaaggaaaacctttgtggacttaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtgtagggaagatgaccctggggatgtgttgcataattacggctagtatcctcctatggtatgcacagatacaaccacactggatagcagcttcaataatactggagttctttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggattgggaagcattacaacccaggaatctgagagcaacatcctggacatagatctacgtcctgcatcagcatggacgctgtatgccgtggctacaacatttttcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataactctcacagcagctcttctcttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctctgtgtgaggctctaaccttagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcctcaccaaatcccacgatagaagcaggacgaacactcagagtcctcaacttagtggaaaattggttgaacaacaacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgaaccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggcagctatgaaacaaaacaaactggatcagcatcatccatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgaaaatcacggcagagtggctttggaaagaactaggaaagaaaaaaatacctaggatgtgtaccagagaagaatttacaagaaaggtgagaagcaatgcagccttgggggccatattcactgatgagaacaaatggaaatcggcacgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaaggatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtagaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6862 - RNA, 9876 nt, synthetic construct
  misc_feature 1..9876: note = derived and/or modified CDS sequence (wt) from DENV-2__FJ898450__SS-prME
  source 1..9876: mol_type = other RNA
acagcaggcgtgattatcatgttgattccaacagcaatggcgttccatttaaccacacgtaatggagaaccacacatgatcgttggtaggcaagagaaagggaaaagtcttctgttcaaaacagaggatggtgttaacatgtgcaccctcatggccatagaccttggtgaattgtgtgaagatacaatcacgtacaagtgtcccctcctcaggcaaaatgaaccagaagacatagattgttggtgcaactccacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctgaatgaagagcaggacaaaaggttcatctgcaaacactccatggtagacagaggatggggaaatggatgtggattatttggaaaaggaggcattgtgacctgtgctatgtttacatgcaaaaagaacatggaaggaaaagtcgtgctgccagaaaatctggaatacaccatcgtgataacacctcactcaggagaagagcacgctgtaggtaatgacacaggaaaacatggcaaggaaattaaaataacaccacagagttccatcacagaagcagaactgacaggctatggcactgtcacgatggagtgctctccgagaacgggcctcgacttcaacgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgctttcagtggggtgtcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcattacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaaccacattctatcagaaaatgaggtaaagttgaccatcatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagtttttaccaccaatatatggctaaaactgagagaaaaacaggatgcattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactctttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcctttagagacctgggaagagtgatggttatggtgggcgctaccatgacggatgacataggcatgggagtgacttaccttgccctactagcagctttcaaagttagaccaacttttgcagctggactactcttgagaaaactgacctccaaggaactaatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatctcgtgtgtcccaaatgcagtgatattgcaaaacgcatggaaggtgagttgcacaatattggcagcggtgtccgtttctccattgctcttaacatcctcacagcagaaagcggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccgttagtggctggagggcttcttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtctttccagtatcgataccaattacggcagcagcatggtacctgtgggaagtgaaaaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagtatagcagctagaggatatatttcaactcgagtagagatgggtgaagcagccgggattttcatgacagccactcctccgggaagtagagacccatttcctcagagcaatgcaccaatcatggatgaggaaagagaaatccctgagcgctcgtggaattcagggcatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggagaacctctggaaaatgatgaagactgtgcacattggaaagaagctaaaatgctcctagataacatcaacacacctgaaggaatcattcctagtatgttcgaaccagagcgtgaaaaggtggatgccattgatggtgagtaccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctctgtgtgaggctctaaccttagcgaccgggcccatctccacactgtgggaaggaaatccagggaggttttggaacactaccattgcagtgtcaatggctaacatctttagagggagctacttggccggagctggacttctcttttccatcatgaagaacacaacaaacacaagaagaggaactggcaacataggagagacacttggagaaaaatggaaaagccgattaaatgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttctcaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacagaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacaacgcgttttcaaagagaaagtggacacgagaacccaagaaccgaaggaaggcacaaagaaactgatgagaattacggcagagtggctttggaaagaactaggaaagaaaaagacgcctaggatgtgtaccagagaagaatttacaagaaaggtgagaagcaatgcagctttgggggccatattcactgatgagaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagatgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtagtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatctttaaaagcattcagcacctgacagtcacagaagaaatcgctgtacagaactggttagcgagagtagggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6863 - RNA, 9876 nt, synthetic construct
  misc_feature 1..9876: note = derived and/or modified CDS sequence (wt) from DENV-2__FJ898453__SS-prME
  source 1..9876: mol_type = other RNA
acagcaggcgtgattgttatgttgattccaacagcgatggcgttccacttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacatagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctgtcagaaaatgaggtaaagttgaccattatgacgggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagttttttccaccaatatatggctaaaattgagagaaagacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggagaacttggtcaactccttggtcacagccggacatgggcagattgacaacttttcactaggagtcttgggaatggcactgttcctggaagaaatgcttaggacccgagtaggaacgaaacatgcaatactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattagcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagtctatagaatcaagcaaagagggattcttggatattctcagattggagccggagtttacaaagaaggaacattccacacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggaggaagggcgtacaatcatgctctcagtgaactgccggagaccctggagacactgcttctactgacactcctggcaacagtcacaggaggaatctttttattcttaatgagcggaaaaggtatagggaagatgactctgggaatgtgttgcataatcacagctagcattctcctatggtatgcacagatacaaccacactggatagcagcttcaataatactggagttttttctcatagttctgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcgcaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaacaacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggtgtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctaggatgtgtactagagaagaattcacaagaaaagtgagaagcaatgcagccttgggtgccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgtcacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttttgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggactctgatgtacttccacagacgtgacctcagattggcggcaaatgccatttgctcggcagtcccgtcacattgggttccgacaagtcgaacaacctggtccatacacgccaagcatgaatggatgacgacggaagacatgctggcagtctggaacagggtgtggatccaagaaaacccatggatggaagacaagactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6864 - RNA, 9876 nt, synthetic construct
  misc_feature 1..9876: note = derived and/or modified CDS sequence (wt) from DENV-2__EU482445__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccttgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgttggtacgggatggaaatcagaccattgaaagagaaagaagaaaatctggttaactccttggtcacagccggacatgggcaggttgacaatttttcactgggagtcttgggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggagccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggaattttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6865 - RNA, 9876 nt, synthetic construct
  misc_feature 1..9876: note = derived and/or modified CDS sequence (wt) from DENV-2__EU482446__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgtaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaattccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcccatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggactccaagcaaaagcaaccagagaagcccagaaaagagcagcggccggcatcatgaaaaacccaaccgttgatggaataacagtgattgatctggatccaataccttatgatccaaagtttgaaaagcagttgggacaagtaatgctactaatcctctgcgtgactcaagtgttgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaatataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggcacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6866 - RNA, 9876 nt, synthetic construct
  misc_feature 1..9876: note = derived and/or modified CDS sequence (wt) from DENV-2__EU482448__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctgctgacagctgtcgctccttcaatgacaatgcgttgcataggaatatcaaatagagacttcgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctctacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggtgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagctgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgatataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaatatcatggcactacgaccaagatcacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6867 - RNA, 9876 nt, synthetic construct
  misc_feature 1..9876: note = derived and/or modified CDS sequence (wt) from DENV-2__EU482449__SS-prME
  source 1..9876: mol_type = other RNA
acagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccggaaaatttggaatacaccatcgtgataacacctcactcaggagaagagcatgccgtaggtaatgacacaggaaaacatggtaaggaaatcaaaataacaccacagagttccaacacagaagcagaactgacaggctatggcacagttacgatggagtgctctccgagaacgggccttgattttaatgagatggtgctgctgcagatggaagacaaagcttggctggtgcacaggcagtggttcctagacctgccgttaccatggctacccggagcggacacacaaggatcaaattggatacagaaagagacactggtcaccttcaaaaatcctcacgcgaagaaacaggatgtcgttgttttaggatctcaagaaggggcaatgcacacggcactcacaggggccacagagatccagatgtcatcaggaaacttactattcacaggacatctcaagtgcaggctgagaatggacaaactacagctcaaaggaatgtcgtactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgttttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccatcttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagagcaatacaagttccaaccagaatccccttcaaaattagcttcagctatccagaaagctcatgaagagggcatttgtgggattcgttcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagcttgaaatggacttcgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttatgacattgattactgggaacatgtcctttagagacctgggaagagtgatggttatggtgggcgctaccatgacggatgacataggtatgggagtgacttatcttgccctactagcagctttcaaagttagaccaactttcgcagctggactactactgagaaagctgacctccaaggaattaatgatggctaccataggaattgcactcctttctcaaagcaccataccagagaccattcttgaactaactgatgcgttagccttgggcatgatggtcctaaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatctttctaacaactctttcgagaaccagcaagaaaaggagctggccgctaaatgaggctatcatggctgtcgggatggtgagcattttagccagttccctcttaaaaaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgttcaaacgaaacctggacttttcaaaaccaacaccggaaccataggcgccgtatctctggacttttctcctggaacgtcaggatccccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaagccataaaacgtggcttaagaacattaatcctagcccccactagagtcgtggcagctgaaatggaggaagctcttagaggacttccaataagataccaaaccccagccatcagagccgagcacaccgggcgggagattgtggacctaatgtgtcatgccacgtttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgttcgtggagctctggacatgaatgggtcacggattttaaagggaagactgtttggtttgttccaagtataaaagcgggaaatgacatagcagcttgtctcaggaaaaatggaaagaaagtgatacaactcagcaggaagacctttgactctgagtatgttaagactaggaccaatgattgggactttgtggtcacaaccgacatttcagaaatgggtgctaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagatgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgttctgcataatcacggctagcatcctcctatggtatgcacagatacaaccacactggatagccgcttcaataatactggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggactgggaagcattgcaactcaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgtggtagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgaccccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggagccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagctcaattaattagacagatggagggagaaggaattttcaaaagcattcagcacctgacagtcacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgagttaatcatgaaagacggccgcgtgcttgtggttccatgcagaaaccaagatgaactgattggcagggcccgaatttctcagggagctgggtggtctttgaaagagactgcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 6868 - RNA, 9876 nt, synthetic construct
  misc_feature 1..9876: note = derived and/or modified CDS sequence (wt) from DENV-2__EU482450__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagttttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggattcgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacttttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtgaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcttggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtgctataccagagaccgtgcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaactaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagccacagggcccatctccacactgtgggaaggaaacccaggaaggttctggaacactaccatagcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgtacactcagagtccttaatttagtagaaaattggttgaacaacaacactcaattttgcataaaagttctcaatccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggaattcggcaaggcaaaaggcagcagagccatatggtacatgtggcttggagctcgcttcctggagtttgaagccctaggattcctaaatgaagaccactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaatgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaagaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacgcagattacatgccatccatgaaaagattcagaagagaagaggaagaagcaggagtcctgtggtaa

SEQ ID NO: 6869 - RNA, 9876 nt, synthetic construct
  misc_feature 1..9876: note = derived and/or modified CDS sequence (wt) from DENV-2__EU569721__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgtaccctcatggctatggatcttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatccttgcggcctcagcccactgagctgaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtctgcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaattatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggttacagccggacatgggcaggttgacaatttttcactgggagtcttgggaatggcattgttcctggaggaaatgcttaggacccgagtaggaacgaaacatgcaatactactagttgcagtttcttttgtgacgttgatcacagggaacatgtccttcaaagacctaggaagagtggtggttatggtaggcgccacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattaactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccctacccatgggaaaggctgaactggaagatggagcctacagaatcaagcaaaaagggattcttgggtattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacatcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagaaaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaattataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatctcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaagaaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattagtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgtttcctggagtttgaagccctaggattcctaaatgaagatcactggttctctagagagaactccctgagtggagtggaaggagaagggctgcacaagctaggttacattctaagagacgtgagcaagaaagagggaggagctatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacccttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaagcatgaatggatgacaacggaagacatgttgacggtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6870 - RNA, 9876 nt, synthetic construct
  misc_feature 1..9876: note = derived and/or modified CDS sequence (wt) from DENV-2__EU482451__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacaggagcagaattgacaggttatggcaccgtcacgatggagtgctccccgagaacaggcctcgacttcaatgagatggtgttgctgcagatggaaaataaagcttggctggtccataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaactatagtcatcagagtgcaatatgaaggggacggctctccatgtaaaatcccttttgaaataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcgtcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcagaaaatgaggtgaagttgactattatgacaggagacattaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggttttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacactaccacccctaagatacagaggtgaggatgggtgctggtacgggatggaaatcagaccattgaaagagaaagaagaaaatctggttaactccttggtcacagccggacatgggcaggttgacaatttttcactgggagtcctgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttctgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctgggaaaaatccaagagccgtccaaacaaaacctggtcttttcaaaaccagcaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcacatttcacagacccagcaagtatagcagctagaggatacatctcaacccgagtggaaatgggtgaggcagctgggattttcatgacagccactcccccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactaaaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatgggattaagaacaaccaaatcctggaagaaaatgtggaagttgaaatctggacaaaagaaggggaaaggaagaaattgaaacccagatggttggatgccaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggaggaatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaagggatggccattgtcaaagatggacatcggagttccccttctcgccattggatgttactcacaagtcaatcccataactctcacagcagctctcctcttattggtagcgcattacgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccatcgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacatggtcacaccagaagggaaagtagtggacctcggttgtggcagaggaggctggtcatactattgcggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctggaaacatagtgtcatcggtgaacatgatttcaaggatgttgatcaatagattcacaatgagacacaagaaagccacttacgagccggatgttgacctcggaagcggaacccgaaacattggaaatgaaagtgaaataccaaacctagacataattgggaaaagaatagaaaaaataaagcaagagcatgaaacatcatggcactacgaccaagaccacccatacaaaacgtgggcatatcatggtagctatgaaacaaaacagactggatcagcatcatccatggtcaatggagtggtcaggctgctgacaaaaccttgggacgtcctccctacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaagctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccagagaggtagtgggcaagttggcacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgactgtgttgtgaaacctttagacgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacggcttgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6871 - RNA, 9876 nt, synthetic construct
  misc_feature 1..9876: note = derived and/or modified CDS sequence (wt) from DENV-2__EU660413__SS-prME
  source 1..9876: mol_type = other RNA
tctgcaggcatgatcattatgctgattccaacagtgatggcgtttcatctaaccacacgcaacggagaaccacacatgatcgtcggtatacaggagaaagggaaaagtcttctgttcaaaacagaggatggagtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacacagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagccgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacactggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaactgacaggttatggcaccgtcacgatggagtgttccccgagaacaggcttcgacttcaatgagatggtgttgctgcagatggaaaataaagcttggctggtgcataggcaatggtttctagacctgccattaccatggctgcccggagcggataaacaagagtcaaattggatacagaaagaaacattggtcaccttcaaaaatccccatgcgaagaaacaggatgttgttattttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattctgggtgacacagcctgggacttcggatccttgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctgatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaataggggaccctctttgagaacaactactgcctccggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggaatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcagtccaacagccatttttctaacgaccctctcaagatccaacaagaaaagaagctggccactaaatgaggctatcatggcagtcggaatggtgagcattttagccagttccctcctaaaaaatgatattcccatgacaggaccactagtggctggagggctcctcactgtgtgttacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgaatgggtcacggattttaaagggaagactgtttggttcgttccaagcataaaagcaggaaatgatatagcagcttgcctgagaaaaaatggaaagaaagtaatacaactcagtaggaagacttttgattcagagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagcaggaagaaagtctctgaccctgaacctaatcacagaaatgggtaggcttccaacattcatgactcagaagacaagagacgcactggacaacctagcagtgctgcacacggctgaagcaggtggaagggcgtacaaccacgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttacttattccagaaccagaaaaacagagaacaccccaagacaaccaattgacctacgttgtcatagccatcctcacagtggtggccgcaaccatggcaaacgagatgggttttctagaaaaaacgaagaaagatcttggattaggaggcattgcaacccagcaacccgagagcaacatcctggacatagacctacgtcccgcatcagcttggacgctgtatgccgtggctacaacattcgttacaccaatgctgagacacagcattgagaattcctcagtgaatgtatccttaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcctatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggtatcaaaagaggagaaacggatcatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccttcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaaaaccaaacctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattaggaaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagagaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagggaagaggaagaagcaggagtcctgtggtaa

SEQ ID NO: 6872 - RNA, 9876 nt, synthetic construct
  misc_feature 1..9876: note = derived and/or modified CDS sequence (wt) from DENV-2__EU660414__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttttgttcaaaacagaggatggtgtgaacatgtgcaccctcatggctatggaccttggtgaattgtgtgaagacacgatcacgtacaagtgtcctcttctcaggcagaatgagccagaagacatagactgctggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttgggtcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggtttaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggggacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcttacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgccatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaaatagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaatcaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactaccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagacccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaagtccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccctagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggccttacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacttagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaagagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacgctagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6873 - RNA, 9876 nt, synthetic construct
  misc_feature 1..9876: note = derived and/or modified CDS sequence (wt) from DENV-2__EU660415__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccgggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacaccccactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagggccgggacaactgaagctcaactggttcaagaaaggaagttctatcggtcaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgtcccaacacaaatagagcttggaactcgttggaggttgaagactacggctttggagtgttcaccaccaatatatggctaaaattgaaagaaaaacaggatgcattctgcgactcaaaactcatgtcggctgccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagactaggctaccatacacaaatagcaggaccatggcacctaggtaagcttgagatggactttgatttctgcgatggaaccacagtgatagtgactgaggactgcggaaatagaggaccctctttgagaacaactactgcctctggaaaacttataacagaatggtgctgccgatcttgcacattaccacccctaagatacagaggtgaggatgggtgctggtacgggatggaaatcagaccattgaaagagaaggaagaaaatctggttaactccttggtcacagccggacatgggcaggtagacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccatttttctaacaaccctctcaagaactaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactagagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaggcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcatactgggcgggaaattgtggatctaatgtgtcatgccacatttaccatgaggctgctatcaccagttagagtgccaaactataatttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgagccagagcgtgaaaaagtggatgccattgatggcgaataccggttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcattcttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggacatagacctacgtcccgcatcagcttggacgttgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttattcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttaatcaacagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccctgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggtcgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagaccactggttctctagagagaactccctgagcggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacagcctgtttggggaagtcttacgctcaaatgtggagcttgatgtatttccacaggcgtgacctcaggctggcggcaaatgtcatttgctcggcagtgccatcacactgggttccaacaagtcgaacaacctggtccatacacgccaaacatgaatggatgacaacggaagacatgttgacagtctggaacagggtgtggattcgagaaaacccatggatggaagataaaaccccagtggaatcatgggaggaaatcccatacttgggaaaaagagaagaccaatggtgcggctcattgatcgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6874 - RNA, 9876 nt, synthetic construct
  misc_feature 1..9876: note = derived and/or modified CDS sequence (wt) from DENV-2__EU687249__SS-prME
  source 1..9876: mol_type = other RNA
tctgcaggcatgatcattatgctgattccaacagtgatggcgtttcatctaaccacacgcaacggagaaccacacatgatcgtcggtatacaggagaaagggaaaagtcttctgttcaaaacagaggatggtgtgaacatgtgtaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacctggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaaggggggcattgtgacctgtgctatgttcacatgcaagaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacaaagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaggagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagttatcagagtgcaatatgaaggggacggctctccatgtaaaatcccttttgagataatggatttggaaaaaagatatatcttaggccgtctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatctctgggaggagtgtttacatctataggaaaagctctccaccaagtctttggagcaatctatggagctgccttcagtggggtttcatggaccatgaaaattctcataggagtcattatcacatggataggaatgaactcacgcagcacctcactgtctgtgtcactggtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagccatccagaaagctcgagaagagggaatttgtgggatccgctcggtaacaagattggagaacctaatgtggaaacaaataacaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaactgaaagaaaaacaggacgcattctgcgactcaaaactcatgtcggcggccataaaagacaacagagccgttcatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactacagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttatgacattgatcacagggaacatgtccttcaaagacctaggaagagtggtggttatggtaggcgctaccatggcggatgacataggtatgggcgtgacttatcttgccctactagcagcttttaaagttagaccaacttttgcagctggactactcttgagaaagctgacctccaaggaattgatgatgaccaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtcagtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagctccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaagaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattcacagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggggaatggaaggaaggagaagaagtccaagtgctggcactggagcctggaaaaaatccaagagccgtccaaacaaaacctggtcttttcaaaaccaacaccggaacaataggtgccgtatctctggacttttcccctggaacgtcaggatctccaattatcgacaaaaaaggaaaagttgtgggtctttatggtaatggtgtagtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcctggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgatcatcatggacgaagcccatttcacagacccagcaagcatagcagctagaggatacatctcaacccgagtggagatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagaccgtttggttcgttccaagcataaaagcaggaaatgatatagcagcctgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgactcactctagtgcagcacaaagaagagggagaataggaagaaatccaaaaaatgaaaatgaccagtacatatacatgggagaacctctggaaaatgatgaagactgtgcacactggaaagaagccaaaatgctcctagataacatcaacacaccagaaggaatcattcctagtatgtttgaaccagagcgtgaaaaagtggatgccattgatggcgaataccgtttgagaggagaagcaaggaaaacctttgtggacttaatgaggagaggagatttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggtaggcttccaacattcatgactcagaagacaagagacgcactggacaacctagcagtgctgcacacggctgaagcaggtgggagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacctgagagcaacatcctggacatagatctacgtcccgcatcagcttggacgctgtatgccgtggctacaacattcgttacaccaatgttgagacatagcattgagaattcctcagtgaatgtatccctaacagctatagccaaccaagcaacagtgttaatgggtctagggaaaggatggccattgtcaaagatggacatcggagttccccttctagccattggatgttactcacaagtcaatcccataactctcacagcagctcttctcttattggtagcgcattatgccattatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggagagtagtggacctcggttgtggcagaggaggttggtcatactattgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgacacattgctgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccctagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgtaacattggaattgaaagtgaagtaccaaacctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtccttcccacggtgacacagatggcaatgacagacacgactccatttggacaacagcgtgttttcaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaacgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtgatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacaatgggaaccttcaaaaggatggagcgattggacacaagtgcccttctgttcacaccatttccatgagctaatcatgaaggatggtcgtgtacttgttgttccatgtaggaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacgacctggtccatacacgccaaacatgaatggatgacaacggaagacatgctgacagtctggaacagggtgtggattcgagaaaacccatggatggaagacaaaaccccagtggaatcatgggaggaaatcccatacctgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6875 - RNA, 9876 nt, synthetic construct
  misc_feature 1..9876: note = derived and/or modified CDS sequence (wt) from DENV-2__EU660416__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagatatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaagaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaagggaagttctatcggccaaatgtttgagacaacgatgagaggggcgaagagaatggccattttgggtgacacagcctgggactttggatccctaggaggagtgtttacgtctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaggcaaaaatgctctccacagagtcttacaaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgttcatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaatgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtcctcaaaatagtaagaaacatggaaaagtatcaattagcagtgaccatcatgactatcttgtgcgtcccaaacgcagtgatattacaaaatgcatggaaagtgagttgcacaatactggcagtggtgtccgtttccccactgcttttgacatcctcacggcaaaaaacggattggataccattagcattgacaatcaagggtctcaatccaacagccatttttctaacaaccctctcaagaaccaacaagaaaagaagctggccactaaatgaggctatcatggcagtcggaatggtgagtattttagccagttccctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggttggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgataaaaaaggaaaagttgtgggtctttatggtaatggtgttgtcacaaggagtggagcatatgtgagtgctatagcccaaactgaaaaaagcattgaagacaaccccgaaatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggtcacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgctcactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaattatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctaaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacgccccaagacaaccaattgacctacgttgtcatagccatcctcacagtggtggccgcaaccatggcaaacgagatgggtttcctagaaaaaacgaagaaggatcttggattgggaagcattgcaacccagcaacccgagagcaacatcctggacatagacttacgccctgcatcagcttggacgctgtatgctgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctaacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatcttcagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaagggctaacaaaaggaggaccaggacacgaagaacccatccctatgtcaacatatgggtggaacctggtgcgtcttcagagtggagttgacgtcttcttcatcccgccagaaaagtgtgacacattgttgtgtgacataggggagtcatcgccaaatcccacagtggaagcaggacgaacactcagagtccttaatttagtggaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgataaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggctcggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggcacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacaaggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6876 - RNA, 9876 nt, synthetic construct
  misc_feature 1..9876: note = derived and/or modified CDS sequence (wt) from DENV-2__EU660417__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagatatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaagaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacgtctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaggcaaaaatgctctccacagagtcttacaaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgttcatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtcctcaaaatagtaagaaacatggaaaagtatcaattagcagtgaccatcatgactatcttgtgcgtcccaaacgcagtgatattacaaaatgcatggaaagtgagttgcacaatactggcagtggtgtccgtttccccactgcttttgacatcctcacggcaaaaaacggattggataccattagcattgacaatcaagggtctcaatccaacagccatttttctaacaaccctctcaagaaccaacaagaaaagaagctggccactaaatgaggctatcatggcagtcggaatggtgagtattttagccagttccctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggttggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgataaaaaaggaaaagttgtgggtctttatggtaatggtgttgtcacaaggagtggagcatatgtgagtgctatagcccaaactgaaaaaagcattgaagacaaccccgaaatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccggcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggtcacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgctcactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaattatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacgccccaagacaaccaattgacctacgttgtcatagccatcctcacagtggtggccgcaaccatggcaaacgagatgggtttcctagaaaaaacgaagaaggatcttggattgggaagcattgcaacccagcaacccgagagcaacatcctggacatagacttacgccctgcatcagcttggacgctgtatgctgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctaacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaagtccaggaaggttctggaacactaccattgcggtgtcaatggctaacatcttcagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaagggctaacaaaaggaggaccaggacacgaagaacccatccctatgtcaacatatgggtggaacctggtgcgtcttcagagtggagttgacgtcttcttcatcccgccagaaaagtgtgacacattgttgtgtgacataggggagtcatcgccaaatcccacagtggaagcaggacgaacactcagagtccttaatttagtggaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgataaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgttgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggctcggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggcacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacaaggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6877 - RNA, 9876 nt, synthetic construct
  misc_feature 1..9876: note = derived and/or modified CDS sequence (wt) from DENV-2__EU677137__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaagatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagacttcgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaggggaaaatcgtgcaaccagaaaacttggaatacactattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgatatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagctggaccatggcacctaggtaagcttgagatggactttgatttctgcgatggaaccacagtgacagtgactgaggactgcggaagtagaggaccctctttgagaacaactactgcctctggaaaactcataacagaatggtgctgccgatcttgcacattaccacccctaagatacagaggtgaggatgggtgctggtacgggatggaaattagaccattgaaagagaaagaagaaaatttggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacagtcaagggtctcaatccaacagccatttttctaacaaccctctcaagaaccaacaagaaaagaagctggccactaaatgaggctatcatggcagtcggaatggtgagcattttagccagttccctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggcagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacctccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttacggtaatggtgttgtcacaaggagtggagcatatgtgagtgctatagcccaaacggaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgagactgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgttcgaaccagagcgtgaaaaagtggatgccattgatggcgaataccgtttgagaggagaagcaaggaaaacatttgtagacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactcagacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggtatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaaaaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaaccggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcaatgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggttgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtga

SEQ ID NO: 6878 - RNA, 9876 nt, synthetic construct
  misc_feature 1..9876: note = derived and/or modified CDS sequence (wt) from DENV-2__EU677138__SS-prME
  source 1..9876: mol_type = other RNA
tctgcaggcatgatcattatgctgattccaacagtgatggcgtttcatctaaccacacgcaacggagaaccacacatgatcgtcggtatacaggagaaagggaaaagtcttttgttcaaaacagaggatggtgtgaacatgtgcaccctcatggctatggaccttggtgaattgtgtgaagacacgatcacgtacaagtgtcctcttctcaggcagaatgagccagaagacatagactgctggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggtttgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaaaaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggtttaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggggacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaacttataacagaatggtgctgccgatcttgcacattaccacccctaagatacagaggtgaggatgggtgctggtacgggatggaaatcagaccattgaaagagaaagaagaaaatctggttaattccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggccgagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaagggctgaactggaagatggagcttacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgccatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagtaatgcaccaatcatagatgaagaaagagaaatccctgaacgttcatggaattctggacatgagtgggtcacggatttcaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggctcccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgttatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttcttttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccctagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggccttacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaagagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggggaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagccacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6879 - RNA, 9876 nt, synthetic construct
  misc_feature 1..9876: note = derived and/or modified CDS sequence (wt) from DENV-2__EU677149__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagatatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaagaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaagggaagttctatcggccaaatgtttgagacaacgatgagaggggcgaagagaatggccattttgggtgacacagcctgggactttggatccctaggaggagtgtttacgtctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaggcaaaaatgctctccacagagtcttacaaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgttcatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtcctcaaaatagtaagaaacatggaaaagtatcaattagcagtgaccatcatgactatcttgtgcgtcccaaacgcagtgatattacaaaatgcatggaaagtgagttgcacaatactggcagtggtgtccgtttccccactgcttttgacatcctcacggcaaaaaacggattggataccattagcattgacaatcaagggtctcaatccaacagccatttttctaacaaccctctcaagaaccaacaagaaaagaagctggccactaaatgaggctatcatggcagtcggaatggtgagtattttagccagttccctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggttggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgataaaaaaggaaaagttgtgggtctttatggtaatggtgttgtcacaaggagtggagcatatgtgagtgctatagcccaaactgaaaaaagcattgaagacaaccccgaaatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccataagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgctcactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaattatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctaaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacgccccaagacaaccaattgacctacgttgtcatagccatcctcacagtggtggccgcaaccatggcaaacgagatgggtttcctagaaaaaacgaagaaggatcttggattgggaagcattgcaacccagcaacccgagagcaacatcctggacatagacttacgccctgcatcagcttggacgctgtatgctgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctaacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatttagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatcttcagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaagggctaacaaaaggaggaccaggacacgaagaacccatccctatgtcaacatatgggtggaacctggtgcgtcttcagagtggagttgacgtcttcttcatcccgccagaaaagtgtgacacattgttgtgtgacataggggagtcatcgccaaatcccacagtggaagcaggacgaacactcagagtccttaatttagtggaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgataaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggctcggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggcacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacaaggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6880 - RNA, 9876 nt, synthetic construct
  misc_feature 1..9876: note = derived and/or modified CDS sequence (wt) from DENV-2__FJ024452__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggaggacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacaacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcatctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtacttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaattagcttcagctatccagaaagctcaagaagagggaatttgtgggatccgctcggtaacgagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaactacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgttggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactggaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaatcaatgattgggatttcgtggttacaactgacatttcagaaatgggtgccaacttcaaagctgagagggttatagaccccagacgctgcatgaaaccagtcatactaacagatggtgaggagcgggtgattctggcaggacctatgccagtaacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgttaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcttagaaaaaacgaagaaggatcttggattaggaagcattgcaacccagcaacccgagagcaacatcctggacatagacctacgccctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggatcatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaacctggtgcgtcttcagagtggagttgacgtcttcttcatcccgccagaaaagtgtgacacattgttgtgtgacataggggagtcatcgccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagtggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctgattgacaaggaaaggaatctccatcttgaaggaaagtgtgagacatgcgtgtacaacatgatgggaaaaagagaaaagaagctaggggaattcggcaaggcaaaaggcagcagagccatatggtacatgtggcttggagcccgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgcgttgtgaaacctttagatgacaggttcgcaaacgctttgacagccctaaatgacatgggaaaggttagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattgccagagcccgaatctcccaaggagcagggtggtctttgcgagagacggcctgtttggggaagtcttacgctcaaatgtggagcttgatgtatttccacaggcgtgatctcaggctggcggcaaatgccatttgctcggcagtgccatcacactgggttccaacaagtcgaacaacctggtccatacacgccaaacatgaatggatgacaacggaagacatgttgacagtctggaacagagtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6881 - RNA, 9876 nt, synthetic construct
  misc_feature 1..9876: note = derived and/or modified CDS sequence (wt) from DENV-2__FJ205877__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctctcctcaggcagaatgagccagaagatatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaagaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaagggaagttctatcggccaaatgtttgagacaacgatgagaggggcgaagagaatggccattttgggtgacacagcctgggactttggatccctaggaggagtgtttacgtctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaggcaaaaatgctctccacagagtcttacaaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgttcatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtcctcaaaatagtaagaaacatggaaaagtatcaattagcagtgaccatcatgactatcttgtgcgtcccaaacgcagtgatattacaaaatgcatggaaagtgagttgcacaatactggcagtggtgtccgtttccccactgcttttgacatcctcacggcaaaaaacggattggataccattagcattgacaatcaagggtctcaatccaacagccatttttctaacaaccctctcaagaaccaacaagaaaagaagctggccactaaatgaggctatcatggcagtcggaatggtgagtattttagccagttccctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggttggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgataaaaaaggaaaagttgtgggtctttatggtaatggtgttgtcacaaggagtggagcatatgtgagtgctatagcccaaactgaaaaaagcattgaagacaaccccgaaatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccataagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggtcacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgctcactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaattatccagacagaaggtggtgttttgatggaattaagaacaaccaaatcctggaagaaaatgtggaagttgaaatctggccaaaagaaggggaaaggaagaaattgaaacccagatggttggatcctaggatctactctgagccccgggcgctaaaagagttcaaagaatttccacccggaagaaagtctctaaccctgaacctaatcacagaaatgggtaggcttccaacattcatgactcagaagacaagagacgcactggacaacctagcagggctgcacacagctgaagcaggtggaagggcggacaatcatgctctcagtgaactggcggagaccctagagacactgcttttactgacacttctggctacaggcacaggagggatctttttattcttgatgagcgggaggggcatagggaagatgaccctgggaatgtgctgcataatcacggctagcatccttctatgggacgcacaaatacagccacactggatagcagcttcaataatactggagttttttctcatagttttgcttattccagaaccagaaaaacagagaacgccccaagacaaccaattgacctacgttgtcatagccatcctcacagtggtgggcgcaaccatgccaaacgagatgggtttcctagaaaaaacgaagaaggatcttggattgggaagcattgcaacccagcaacccgagagcaacatcctggacatagacttacgccctgcatcagcttggacgctgtatgctgtggctacaacatttgttacaccaatgctgagacatagcattgagaattcctcagtgaatgtatccctaacagctatagccaaccaagcgacagtgttaatgggtctagggaaaggatgggcattggcaaagatggacatcggagttccccttctcggcattggatgttactcacaagtcaatcccataactctaacaggagctctcctcttattgggagggcattatgccatcatagggccaggacttcaagcaaaagcaaccagagaagcccagaaaagagcagcgccgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatcttcagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtgccagaggaggctggtcatactattgtggaggactaaaaaacgtaagagaagtgaaagggctaacaaaaggaggaccaggccacgaagaacccatccctatgtcaacatatgggtggaacctggtgcgtcttcagagtggagttgacgtcttcttcatcccgccagaaaagtgtgacacattgttgtgtgacataggggagtcatcgccaaatcccacagtggaagcaggacgaacactcagagtccttaatttagtggaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgataaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagacccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaagccagcagagccatatggtacatgtggctcggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttgccacctatggactcaatactttcaccaatatggaagcccaattaatcagacagatggagggagaaggagtctttaaaaacatccagcacctgacagtcacagaagaagttgccgtgcaaaactggttggcaagagtgggccgcgaaaggttgccaagaatggccatcagtggagatgattgtgttgtgaaacctttagatgccaggttcgcaaacgctttgacagccctaaatgccatgggaaagattagaaaagatatacaacagtgggaaccttcaaaaggatggaacgattggacacaagtgcccttctgttcacaccatttccatgagctaatcatgaaggatggccgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacaaggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6882 - RNA, 9876 nt, synthetic construct
  misc_feature 1..9876: note = derived and/or modified CDS sequence (wt) from DENV-2__FJ024454__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttttgttcaaaacagaggatggtgtgaacatgtgcactctcatggctatggaccttggtgaattgtgtgaagacacgatcacgtacaagtgtcctcttctcaggcagaatgagccagaagacatagactgctggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggtttgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggccccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatcctcatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgattacagtcaacccaattgtaacagaaaaagacagcccagtcaacatagaagcagaacctccattcggagacagctacatcatcataggagtagagccgggacaactgaagctcaactggtttaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggggacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaaccactgcctctggaaaacttataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctagaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggccgagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcttacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgccatagcccaaactgaaaaaagcattgaaaacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagtaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggccaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacgttcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgttactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccctagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggccttacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacttagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaccggagtggtcaggctgctgacaaaaccttgggacgtcctccccacggtgacacagatggcaatgacagacacgactccatttggacaacagcgtgtttttaaagaaaaagtggacacgagaacccaagacccgaaagaagccacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaagagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgccagtcacagaagaagttgccgtgcaaaactggttggcaagagtggggcgcgaaaggttgtcaagaatgcccatcagtggagatgattgtgttgtgaaacctttagatgccaggttcccaaccgctttgacacccctaaatgacatgggaaagattagaaaagatatccaccagtgggacccttcaaaaggatggaacgattggacacaagtccctttctgttcccaccatttccatgagctaatcatgaaggatggtcgtgtacttgttgttccatgtagaaaccaagatgacctgattgccagagcccgaatctcccaaggaccagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6883 - RNA, 9876 nt, synthetic construct
  misc_feature 1..9876: note = derived and/or modified CDS sequence (wt) from DENV-2__FJ205878__SS-prME
  source 1..9876: mol_type = other RNA
tctgcaggcatgatcattatgttgattccaacagtgacggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaattacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggattctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcactgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtatcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagttggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacagagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactaaccatcatggacctccacccaggagcaggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatttaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagagatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaactgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccatggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgagagacggcctgtttggggaagtcttacgctcaaatgtggagcttgatgtatttccacaggcgtgatctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcactgattgggttaacaagcagggccacatgggcaaagaacatccaagcagcaataaatcaggttagatctcttataggcaatgaggaatacacagactacatgccatccatgaaaagattcagaagagaagaggaagaagcaggagtcctgtggtaa

SEQ ID NO: 6884 - RNA, 9876 nt, synthetic construct
  misc_feature 1..9876: note = derived and/or modified CDS sequence (wt) from DENV-2__FJ205879__SS-prME
  source 1..9876: mol_type = other RNA
tctgcaggtatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttctatgacaatgcgttgcataggaatatcaaatagagactttgtagaaggggtttcaggaggaagttgggttgacatagtcttagaacatggaagctgtgtgacgacgatggcaaaaaataaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcatctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggctatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatccctttcgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgaccattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggacgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaacggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaatatggaaaagtatcaattagcagtgaccatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctatagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggagggggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctagacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccattccctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaggtggatgccattgatggcgaataccgtttgagaggagaagcaaggaaaacatttgtggacttgatgaggagaggagacttaccagtttggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggcaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataaccacggctagcatccttctatggtacgcacaaatacagccacactggatagcagcctcaataatactggagttttttctcatagttttgctcattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacccaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatacatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaacagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgctcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgttcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6885 - RNA, 9876 nt, synthetic construct
  misc_feature 1..9876: note = derived and/or modified CDS sequence (wt) from DENV-2__FJ390385__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagccttctgttcaaaacagaggatggtgtgaacatgtgcaccctcatggccatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagccgataaacaagagtcaaattggatacagaaagaaacattggtcacttttaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgcaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaggagggaatttgtgggattcgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgggttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagatctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatatcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcccagtatgtttgaaccagagcgtgaaaaggtggatgccattgatggcgaataccgtttgagaggagaagcaaggaaaacatttgtggacttaatgaggagaggagacttaccagtctggctggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgctaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcagcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaactgaaagtgaaataccaaacctagacataattggaaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactctctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatgaaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6886 - RNA, 9876 nt, synthetic construct
  misc_feature 1..9876: note = derived and/or modified CDS sequence (wt) from DENV-2__FJ024458__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccgggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacaccccactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggtctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggtcaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaagacgatctttgcggcctcagcccactgagctaaagtattcatggaaaacatggggtaaagcaaaaatgctctccacagagtcttataaccaaacctttctcattgatggccccgagacggcagagtgtcccaacacaaatagagcttggaactcgttggaggttgaagactacggctttggagtgttcaccaccaatatatggctaaaattgaaagaaaaacaggatgcattctgcgactcaaaactcatgtcggctgccataaaagacaacagagccgtccatgccgacatggattactggatagaaagtgcactcaatgacacatggaagatagagaaagcctctttcattgaggtaaaaaactgccactgggcaaaatcacacaccctctggagtaatggagtgctagaaagtgagatgataatcccaaagaatctcgctggaccagtgtctcaacacaactatagactaggctaccatacacaaatagcaggaccatggcacctaggtaagcttgagatggactttgatttctgcgatggaaccacagtgatagtgactgaggactgcggaaatagaggaccctctttgagaacaactactgcctctggaaaacttataacagaatggtgctgccgatcttgcacattaccacccctaagatacagaggtgaggatgggtgctggtacgggatggaaatcagaccattgaaagagaaggaagaaaatctggttaactccttggtcacagccggacatgggcaggtagacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccatttttctaacaaccctctcaagaactaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagacggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactagagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataatttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgagccagagcgtgaaaaagtggatgccattgatggcgaataccggttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcattcttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggacatagacctacgtcccgcatcagcttggacgttgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttattcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttaatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccctgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggtcgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagaccactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacagcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagataaaaccccagtggaatcatgggaggaaatcccatacttgggaaaaagagaagaccaatggtgcggctcattgatcgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6887 - RNA, 9876 nt, synthetic construct
  misc_feature 1..9876: note = derived and/or modified CDS sequence (wt) from DENV-2__FJ205880__SS-prME
  source 1..9876: mol_type = other RNA
tctgcaggcatgatcattatgctgattccaacagtgatggcgttccatctaaccacacgcaacggagaaccacacatgatcgttggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgcaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgtaagaagaacatggaagggaaaatcgtgcaaccagaaaatttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgcaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtttttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagttaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcatcctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattccttggtcacagccggacatgggcaggttgacaatttttcactgggagtcttgggaatggcattgttcctggaggaaatgcttaagacccgagtaggaacgaaacatgcaatactactagttgcagtttcttttgtgacattgatcacagggaacatgtccttcaaagacctaggaagagtggtggttatggtaggcgccacaatggcggatgacataggtatgggcgtgacctatctcgccctactagcagcctttaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccaggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgaccttggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggccattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcggtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagtcctgtggtaa

SEQ ID NO: 6888 - RNA, 9876 nt, synthetic construct
  misc_feature 1..9876: note = derived and/or modified CDS sequence (wt) from DENV-2__FJ390387__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcttggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaactttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgctgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaagtcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgttcacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggctgatagtggttgtgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccttactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccatccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacttttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaaggaaagactgtttggttcgttccaagcataaaagcaggaaatgatatagcagcttgcctgagaaaaaatggaaagaaagtgatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagccatagccaaccaagcgacagtgttaatgggtctggggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagctgggacaagtaatgctactaatcctctgcgtgactcaagtattgatgatgaggactacatgggctctgtgtgaggccttaaccttagctacagggcccatctccacattgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaatttcagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgcggaggactaaaaaacgtaagagaagtgaaaggcctaacaaaaggaggaccaggacacgaagaacctatccctatgtcaacatatggatggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgttgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagttaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgcgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggctggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactggttggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaagagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6889 - RNA, 9876 nt, synthetic construct
  misc_feature 1..9876: note = derived and/or modified CDS sequence (wt) from DENV-2__FJ024461__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccgggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggacaagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacaccccactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcacttacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggtcaaatgtttgagacaacgatgagaggggcgaagagaatggccattttgggtgacacagcctgggactttggatctctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgaccattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgtcccaacacaaatagagcttggaactcgttggaggttgaagactacggctttggagtgttcaccaccaatatatggctaaaattgaaagaaaaacaggatgcattctgcgactcaaaactcatgtcggctgccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagactaggctaccatacacaaatagcaggaccatggcacctaggtaagcttgagatggactttgatttctgcgatggaaccacagtgatagtgactgaggactgcggaaatagaggaccctctttgagaacaactactgcctctggaaaacttataacagaatggtgctgccgatcttgcacattaccacccctaagatacagaggtgaggatgggtgctggtacgggatggaaatcagaccattgaaagagaaggaagaaaatctggttaactccttggtcacagccggacatgggcaggtagacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccatttttctaacaaccctctcaagaactaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactagagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaggcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcatactgggcgggaaattgtggatctaatgtgtcatgccacatttaccatgaggctgctatcaccagttagagtgccaaactataatttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacctttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgagccagagcgtgaaaaagtggatgccattgatggcgaataccggttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgctcttactgacacttctggctacagtcacaggagggatctttttattcttgatgagcgggaggggcatagggaagatgaccctgggaatgtgctgcataatcacggctagcattcttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggacatagacctacgtcccgcatcagcttggacgttgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttattcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttaatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacttcatggcactacgaccaagaccacccatacaaaacgtgggcataccatggtagctatgaaacaaaacagactggatcagcatcatccatggtcaacggagtggtcaggctgctgacaaaaccctgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggtcgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagaccactggttctctagagagaactccctgagcggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtgatggacatcatatcgagaagagaccaaagaggtagtgggcaagttggtacctatggactcaatactttcaccaatatggaagcccaattaatcagacagatggagggagaaggagtcttcaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacagcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagataaaaccccagtggaatcatgggaggaaatcccatacttgggaaaaagagaagaccaatggtgcggctcattgatcgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6890 - RNA, 9876 nt, synthetic construct
  misc_feature 1..9876: note = derived and/or modified CDS sequence (wt) from DENV-2__FJ373299__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttttgttcaaaacagaggatggtgtgaacatgtgcaccctcatggctatggaccttggtgaattgtgtgaagacacgatcacgtacaagtgtcctcttctcaggcagaatgagccagaagacatagactgctggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggtttaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggggacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacagcagagtgccccaacacaaatagagcttggaactcgttggaggttgaagactacggctttggagtgttcaccaccaatatatggctaaaattgaaagaaaaacaggatgcattctgcgactcaagactcatgtcggcggccataaaagacaacagagccgtccatgccgacatgggttactggatagaaagtgcactcaatgacacatggaaaatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggctgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcccatatcaataccaatcacggcagcagcatggtacctgtgggaagtgaagaaacaacgggccggagtattgtgggacgttccttcacccccacccatgggaaaggctgaactggaagatggagcttacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgccatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacactaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctggaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccctagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggccttacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgaggaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaagagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtaaaacctttagatgacaggttcgcaaacgctttgacagccctaaatgacatgggaaagattagaaaagatatacaacagtgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6891 - RNA, 9876 nt, synthetic construct
  misc_feature 1..9876: note = derived and/or modified CDS sequence (wt) from DENV-2__FJ410193__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaataaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcatctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaacggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacggaatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaatatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggagggggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctagacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccattccctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaggtggatgccattgatggcgaataccgtttgagaggagaagcaaggaaaacatttgtggacttgatgaggagaggagacttaccagtttggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggcaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataaccacggctagcatccttctatggtacgcacaaatacagccacactggatagcagcctcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatacatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgctgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccagcaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgctcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctctcataggcaatgaggaatacacagattacatgccatccatgaaaagattcagaagagaagaggaagaagcaggagtcctgtggtaa

SEQ ID NO: 6892 - RNA, 9876 nt, synthetic construct
  misc_feature 1..9876: note = derived and/or modified CDS sequence (wt) from DENV-2__FJ410195__SS-prME
  source 1..9876: mol_type = other RNA
tctgcaggcatgattattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaaatattcatggaaaacatggggtaaagcaaaaatgctctccacagagtcttataaccaaacctttctcattgatggccccgagacggcagagtgccccaacacaaatagagcctggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaactacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaagaaatgcttaggacccgagtaggaacgaaacatgcaatactactagttgcagtttcttttgtgacattgatcacagggaacatgtccttcaaagacctaggaagagtggtggttatagtaggcgccacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatgactatcttgtgcgtcccaaacgcagtgatattacaaaatgcatggaaagtgagttgcacaatactggcagtggtgtccgtttccccactgcttttgacatcctcacggcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgacattcccatgacaggaccactagtggctggaggactcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggacttcttcctatatcaataccaatcacggcagcagcatggtacctgtgggaagtgaagaaacaacgggccggagttttgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggtcacaactgacatttcagaaatgggtgccaatttcaaagctgagagggttatagaccccagacgctgcatgaaaccagtcatactaacagatggtgaggagcgggtgattctggcaggacccatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaattatgcagacagaaggtggtgttttgatggaattaagaacaaccaaatcctggaagaaaatgtggaagttgaaatctggacaaaagaaggggaaaggaagaaattgaaacccagatggttggatgctaggatctattctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacgccccaagacaaccaattgacctacgttgtcatagccatcctcacagtggtggccgcaaccatggcaaacgagatgggtttcctagaaaaaacgaagaaggatcttggattgggaagcattgcaacccagcaacccgagagcaacatcctggacatagacctacgccctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatcttcagagggagttacttggctggagctggacttctcttttccattatgaagaacacaaccaacacaagaaggggaactggcaacatgggagagacgcttggagagaaatggaaaagccgattgaacgcactgggaaaaaatgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaacctggtgcgtcttcagagtggagttgacgtcttcttcatcccgccagaaaagtgtgacacattgttgtgtgacataggggagtcatcgccaaatccaacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcgaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaatttacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagagggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacattcaagcagcaataaatcaggttagatctcttataggcaatgaggaatacacagattacatgccatccatgaaaagattcagaagagaagaggaagaagcaggagtcctgtggtaa

SEQ ID NO: 6893 - RNA, 9876 nt, synthetic construct
  misc_feature 1..9876: note = derived and/or modified CDS sequence (wt) from DENV-2__FJ432726__SS-prME
  source 1..9876: mol_type = other RNA
tctgcaggcatgatcattatgctgattccaacagtaatggcgttccatctaaccacacgcaacggagaaccacacatgatcgtcggtatacaggagaaagggaaaagtcttctgttcaaaacagaggatggcgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagttctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcatgcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggttcctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactatctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcggtaacaagattggagaacctaatgtggaaacaaataacaccagaattaaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagcgtctcaacacaactatagaccaggctaccatacacaaatagcgggaccatggcacctaggtaagcttgagatggactttgatttctgcgatggaaccacagtgatagtgactgaggactgcggaaatagaggaccctctttgagaacgactactgcctctggaaaactcataacagaatggtgctgccgatcttgcacattaccacccctaagatatagaggtgaggatggatgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagccgccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccgagagccgtccaaacaaaacctggtctttttaaaaccaacaccggaacaataggtgccgtatctctggacttttcccctggaacgtcaggatctccaatcatcgacaaaaaagggaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtctgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgatcatcatggacgaagcccatttcacagacccagcaagtatagcagctagaggatacatctcaacccgagtggaaatgggtgaggcagctgggattttcatgacagccactcccccgggaagtagagatccattccctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctggggatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagagaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaacgtatccctaacagctatagccaaccaagcaacagtgttaatgggtctagggaaaggatggccattgtcaaagatggacatcggagttccccttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtccttcccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaaatcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctctgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcgaagaacatccaagcagcaataaatcaggttagatctcttataggcaatgaggaatacacagattacatgccatccatgaaaagattcagaagagaagaggaagaagcaggagtcctgtggtaa

SEQ ID NO: 6894 - RNA, 9876 nt, synthetic construct
  misc_feature 1..9876: note = derived and/or modified CDS sequence (wt) from DENV-2__JF730049__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaactgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagtctaaaagaagagcaggataagaggttcgtctgcaaacactccatggtagacagaggatggggaaatggatgtggattatttggaaagggaggcattgtgacctgtgccatgttcacatgcaaaaagaacatggaagggaaaatcgtgcaaccagaaaatttggaatacaccattgtggtaacacctcactcaggggaggagcatgtggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtgacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccctcaaaactagcttcagctatccagaaagctcaagaagagggaatttgtgggatccgctcggtaacaagattggagaacctaatgtggaaacaaataacaccagaattgaatcacattctaacagaaaatgaggtgaagttgactattatgacaggagacatcaaaggaatcatgcaggcaggaaaacgatctttgcggcctcagcccactgagctaaagtattcatggaaaacatggggtaaagcaaaaatgttctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtgaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccggtcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaagacccgagtaggaacgaaacatgcaatactactagttgcagtttcttttgtgacattgatcacagggaacatgtccttcaaagacctaggaagagtggtggtcatggtaggcgctacaatggcggatgacataggtatgggcgtgacttatcttgccctactagcagcctttaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttagaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctgaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacattgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccagcaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagctcaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacattctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggtaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggaatcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcacggatgttgatcaatagattcacaatgagacacaagaaagccacttatgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaatggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttaggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggccattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaattgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctctgataggcattgaggaatacacagattacatgccatccatgaaaagattcagaagagaagaggaagaggcaggagtcctgtggtaa

SEQ ID NO: 6895 - RNA, 9876 nt, synthetic construct
  misc_feature 1..9876: note = derived and/or modified CDS sequence (wt) from DENV-2__FJ562098__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacagaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgcgctatgttcacatgcaaaaagaacatggaagggaaaatcgtgcaaccagaaaacttggaatacaccattgtggtaacacctcactcaggggaggagcatgcagtcggaaatgacacaggaaaacatggcaaggaaatcaaagtgacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcttgatcacagtcaacccaattgcaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccattgagctaaagtattcatggaaaacatggggtaaggcaaaaatgctctccacagagtctcacaaccaaacctttctcattgatggccccgagacggcagagtgccccaacacaaatagagcttggaactcgttggaggttgaagactacggctttggagtgttcaccaccaatatatggctaagattaaaagaaaaacaggatgcattctgcgactcaaaactcatgtcggcggccataaaagacaacagagctgtccatgccgacatgggttactggatagaaagtgcactcaatgacacatggaagatagagaaagcctctttcattgaggtaaaaaactgccactggccaaaatcacacaccctctggagtaatggagtgctagaaagtgagatggtaatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccttctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtaacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccctcatgggcggacgtcaaaaaagatctaatatcatatggaggaggctggaagctagaaggagaatggaaggaaggagaagaagtccaggtgctggcactggagcctgggaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttacaatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagcaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagtattgagaattcctcagtgaatgtatccctaacagctatagccaaccaagcaacagtgttaatgggtctagggaaaggatggccattgtcaaagatggacatcggagttcccctcctcgccattggatgttactcacaagtcaatcccataactctcacagcagctctcctcttattggtagcgcattatgccatcatagggccaggacttcaagcaaaagcaaccagagaagcccagaaaagagcagcggcgggtatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgatgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagttctcaacccatatatgccctcagttatagaaaaaatggaagcactgcaaaggaaatatggaggagccttagtgaggaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgaccttggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagaatggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatcttcatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctgaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaacactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgcgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatctatgaaaagattcagaagagaagaggaagaagcaggagtcctgtggtaa

SEQ ID NO: 6896 - RNA, 9876 nt, synthetic construct
  misc_feature 1..9876: note = derived and/or modified CDS sequence (wt) from DENV-2__FJ859028__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttttgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtagtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaattcaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggtttaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagcgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaaaacaacagagccgtccatgccgacatgggttattggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtggtagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggtcatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctggaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgccatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattccggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggtcacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcccactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattgggaagcattgcaacccagcaacccgagagcaatatcctggacatagacctacgtcccgcatcagcttggacgctgtatgccgtggctacaacatttgttacaccaatgctgagacatagcattgagaattcctcagtgaatgtatccctaacagccatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagaaacacttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatattattgtggaggactaaaaaacgtaagagaagtgaaaggccttacaaaaggaggaccaggacacgaagaacccatccctatgtcaacatatgggtggaatctggtgcgtcttcagagtggagttgacgtcttctttatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactacaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccatccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtgatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcactgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6897 - RNA, 9876 nt, synthetic construct
  misc_feature 1..9876: note = derived and/or modified CDS sequence (wt) from DENV-2__FJ410200__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtgggttatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttaatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggaggactcctcactgtgtgctacgtgctcactggacgatcggccgacttggaactggagagagcaaccgatgtcaaatgggaagaccaagcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatccctggacttttcccctggaacgtcaggatctccaatcatcgacaaaaaaggaaaagttgtgggtctttatggtaatggtgttgtcacaagaagtggagcatatgtgagtgctatagcccaaactgaaaaaagcattgaaaacaaccccgagatcgaagatgacattttccgaaagagaagactgaccatcatggacctccacccaggagcgggaaagacgaaaagataccttccagccatagtcagagaagccataaaacggggtttgagaacgttaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatatggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacgcttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccggcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccgataccttatgatccaaagtttgaaaagcagttgggacaagtaatgctactagtcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaactgaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctcctgacaaaaccttgggacgtccttcccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggaggtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttatattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6898 - RNA, 9876 nt, synthetic construct
  misc_feature 1..9876: note = derived and/or modified CDS sequence (wt) from DENV-2__FJ410202__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaagcatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtgacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctgtaggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctctgcggcctcagcctactgagctaaagtattcatggaaaacatggggtaaagcaaaaatgctctccacagagtcttataaccaaacctttctcattgatggccccgagacggcagagtgtcccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtatgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacctttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctagacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagatatcttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagctcatttcacagacccagcaagtatagcagctagaggatacatctcaacccgagtggaaatgggtgaggcagctgggattttcatgacagccactcccccgggaagtagagatccatttcctcagagcaatgcaccaatcatagatgaggaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaggtggatgccattgatggcgaataccgtttgagaggagaagcaaggaaaacgtttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaagtctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctacacacggctgaagtaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacaaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggactccaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggccaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtggaaaattggttgaacaataacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacagtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaacgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagctctaaatgacatgggaaagattagaaaagatatacaacagtgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcagcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacatagattacatgccatccatgaaaagattcagaagagaagaggaagaagcaggagtcctgtggtaa

SEQ ID NO: 6899 - RNA, 9876 nt, synthetic construct
  misc_feature 1..9876: note = derived and/or modified CDS sequence (wt) from DENV-2__FJ410208__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggccatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccacacacaaatagcaggaccatggcacctaggtaagcttgagatggactttaatttctgtgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccactgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagacctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatccctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacgttaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatatggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaattgccggagaccctagagacactgcttttactgacgcttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccggcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactagtcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaatatgatagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccgggacacgaagaacccatccccatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6900 - RNA, 9876 nt, synthetic construct
  misc_feature 1..9876: note = derived and/or modified CDS sequence (wt) from DENV-2__FJ461305__SS-prME
  source 1..9876: mol_type = other RNA
tctgcaggcatgatcattatgttgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggattttgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattgtttggaaagggaggcattgtgacctgtgctatgttcacatgcaaaaagaacatggaagggaaaatcgtgcaaccagaaaatttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcaaatggaaaataaagcttggctggtgcataggcaatggtttctagacctgccattaccatggctgcccggagcggataaacaagagtcaaattggatacagaaagagacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagttcaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgctttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctagttaactccttggtcacagccggacatgggcagattgacaatttttcactgggagtcttgggaatggcattgttcctggaggaaatgcttaagacccgagtaggaacgaaacatgcaatactactagttgcagtttcttttgtgacattgatcacagggaacatgtccttcaaagacctagggagagtggtggttatggtaggcgctacaatggcggatgacataggtatgggcgtgacttatcttgccctactagcagcctttaaagttagaccaacctttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctatcaataacaatatcagaagatggtagcatgtcgataaaaaatgaagaggaagaacaaacactgaccatactcattagaacaggattgctggtaatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcccggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgagaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggcaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacaccaccattgcggtgtcaatggctaacatctttagagggagttacctggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacacacaattttgcataaaagttctcaacccatatatgccctcagttatagaaaaaatggaagcactgcaaaggaaatatggaggagccttagtgaggaatccactctcacggaactccacacatgagatgtactgggtatccaatgcttctgggaacatagtgtcatcagtgaacatgatttcaaggatgttgatcaatagattcacaatgagacacaagagagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaagtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggccattttcaaactaacgtatcaaaacaaggtggtgcgtgtgcaaagaccaacgccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaagcatgaatggatgacaacggaagacatgttgacagtctggaacagggtgtggattcgagaaaacccatggatggaagacaaaactccagtggaatcatgggaggaaattccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagtcctgtggtaa

SEQ ID NO: 6901 - RNA, 9876 nt, synthetic construct
  misc_feature 1..9876: note = derived and/or modified CDS sequence (wt) from DENV-2__FJ410215__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcagtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttctagggtcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcggaaaatgaggtgaagttgactattatgacaggagacatcaaaggaatcatgcaggcaggaaaacgatctttgcggcctcagcccactgagctaaagtattcatggaaaacatggggtaaagcgaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctcaggaaaactcataacagaatggtgctgccgatcttgcacactaccacccctaagatacagaggtgaagatgggtgctggtacgggatggaaatcagaccattgaaagagaaagaagaaaatctggttaactccttggtcacagccggacatgggcaggttgacaatttttcactgggagtcttgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctgcaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttctgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggcttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccaggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatgggattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctaaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactccttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaactgacctacgttgtcatagccatcctcacagtggtggccgcaaccatggcaaacgagatgggtttcctagaaaaaacgaagaaggattttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccatcggatgttactcacaagtcaaccccataactctcacagcagctctcctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggctttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacatggtcacaccagaagggaaagtagtggacctcggttgcggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaaactaggggaattcggcaaggcaaaaggcagcagagccatatggtacatgtggcttggagctcgcttcctggagtttgaagccctaggattcctaaatgaagatcactggttctctagagagaactccctaagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgcgtgcaaaggccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgggaaacggcctgtttggggaagtcttacgcccaaatgtggagtttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagcagcaataaatcaggttagatctcttataggtaatgaggaatacacagattacatgccatccatgaaaagattcagaagagaagaggaagaagcaggagtcctgtggtaa

SEQ ID NO: 6902 - RNA, 9876 nt, synthetic construct
  misc_feature 1..9876: note = derived and/or modified CDS sequence (wt) from DENV-2__FJ461309__SS-prME
  source 1..9876: mol_type = other RNA
tctgcaggcatgatcattatgttgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggattttgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattgtttggaaagggaggcattgtgacctgtgctatgttcacatgcaaaaagaacatggaagggaaaatcgtgcaaccagaaaatttggaatacaccattgtggtgacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcaaatggaaaataaagcttggctggtgcataggcaatggtttctagacctgccattaccatggctgcccggagcggataaacaagagtcaaattggatacagaaagagacattggtcactttcaaaaatccccatgcgaagaaacaggacgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagttcaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctatagggaaagctctccaccaagtctttggagcaatctatggagccgcttttagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggcaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattttgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatctagttaactccttggtcacagccggacatgggcaggttgacaatttttcactgggagtcttgggaatggcattgttcctggaggaaatgcttaagacccgagtaggaacgaaacatgcaatactactagttgcagtttcttttgtgacattgatcacagggaacatgtcctttaaagacctaggaagagtggtggttatggtaggcgctacaatggcggatgacataggtatgggcgtgacttatcttgccctactagcagcctttaaagttagaccaactttcgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctatcaataacaatatcagaagatggtagcatgtcgataaaaaatgaagaggaagaacaaacactgaccatactcattagaacaggattgctggtaatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccattttacagatccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaaaaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgagaatgaccagtacatatacatgggagaacctctggaaaatgatgaagactgtgcacactggaaagaagccaaaatgctcttagataacattaacacaccagaaggaatcattcctagtatgttcgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatggtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgtttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggccattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcctttctgctcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtattttcacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaactccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaagaatacacagattacatgccatccatgaaaagattcagaagagaagaggaagaggcaggagtcctgtggtaa

SEQ ID NO: 6903 - RNA, 9876 nt, synthetic construct
  misc_feature 1..9876: note = derived and/or modified CDS sequence (wt) from DENV-2__FJ461311__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacacgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggattttgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttaatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacctatcttgccctactagcagccttcaaagttagaccaacctttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggactggataccattagcattgacaatcaagggtctcaacccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggatgtcaaaaaagatctaatatcatatggaggaggctggaagctagaaggagaatggaaggaaggagaagaagtccaggtgctggcactggaacctggaaaaaatccaagagccgtccaaacaaaacccggtcttttcaaaaccaacaccggaacaataggtgctgtatccctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagggaagccataaaacggggtttgagaacgttaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagttatactaacagatggtgaggagcgggtgattcttgcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggggaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatatggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacgcttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccggcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactagtcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccaattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcataagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggctatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggttcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6904 - RNA, 9876 nt, synthetic construct
  misc_feature 1..9876: note = derived and/or modified CDS sequence (wt) from DENV-2__FJ410217__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaatatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcagtcggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgttgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatctgggagtcatggtgcaggccgatagtggttgcattgtgagctggaaaaacaaagaactgaaatgtggcagtgggattttcgtcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcacaaccaaacctttctcattgatggccccgagacggcagagtgccccaacacaaatagagcttggaactcgttggaggttgaagactacggctttggagtgttcaccaccaatatatggctaagattgaaagaaaaacaggatgcattctgcgactcaaaactcatgtcggcggccataaaagacaacagagccgtccatgccgacatgggttactggatagaaagtgcactcaatgacacatggaagatagagaaagcttctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccttctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactggttgcagtttcttttgtgacattgattacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccctaggcatgatggtccttaaaatagtaagaaacatggaaaagtatcaattggcagtgactatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaacgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggatttttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgagaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttacaatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagcaggaagacttttgattctgagtatgtcaagactagaaccaatgattgggatttcgtggttacaactgacatttcagaaatgggtgccaatttcaaagctgagagggttatagaccccagacgctgcatgaaaccagtcatactagcagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaactgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagtgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacaaagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagtattgagaattcctcagtgaatgtatccctaacagcaatagccaaccaagcaacagtgttaatgggtctagggaaaggatggccattgtcaaagatggacatcggagttccccttcttgccattggatgttattcacaagtcaatcccataactctcacagcagctctcctcttattggtagcgcattatgccatcatagggccaggacttcaagcaaaagcaaccagagaagcccagaaaagagcagcggcgggcatcatgaaaaacccaactgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacgcaagaaggggaactggcaacatgggagagacgcttggagagaagtggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagttctcaacccatatatgccctcagttatagaaaaaatggaagcactgcagaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctgaatgaagatcactggttctctagagagaactccctgagcggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagcgggcaagttggtacctatggactcaacactttcaccaatatggaagcccaattaatcagacagatggagggagaaggagtctttaaaaacatccagcacctgacggtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6905 - RNA, 9876 nt, synthetic construct
  misc_feature 1..9876: note = derived and/or modified CDS sequence (wt) from DENV-2__FJ410219__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgcaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcgatcttggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaactttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatcctgatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaaactcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggctgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatttttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggactcgagtaggaatgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacttccaaggaattgatgatgattaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgcttactggacgatcggccgacttggaactggagagagtaaccgatgtcaaatgggaagaccaggcagagatatcaggaagcagtccaatcctgtcaataacaatatcagaagatggtagcatgtcgataaaaaatgaagaggaagaacaaacactgaccatactcattagaacagggttgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccatccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacttttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaatttcagatctacaagaaaagtggaatccaggaagtggatagaaccttagcaaaagaaggcataaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacctatccctatgtcaacatatggatggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaatatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagttaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6906 - RNA, 9876 nt, synthetic construct
  misc_feature 1..9876: note = derived and/or modified CDS sequence (wt) from DENV-2__FJ461314__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaagatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctgcagcttaaaggaatgtcatactccatgtgcacaggaaagtttaaagttgtgaaggaaatagcagaaacacaacatggaacgatagtcatcagagtgcaatatgaaggggacggctccccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatcgataggaaaagctctccaccaagtctttggagcaatctatggagctgccttcagtggggtttcatggaccttgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagtcgcagtttcttttgtgacattgatcacagggaacatgtccttcaaagacctaggaagagtggtggttatggtaggtgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcagaaaacggattggataccattagcattgacaatcaagggtctcaatccaacagccatttttctaacaaccctctcaagaaccaacaagaaaagaagctggccactaaatgaggctatcatggcagtcggaatggtaagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagacctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacatttttcgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtctgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctacacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagctgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacacactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggtttgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttatgtgacataggggagtcatcaccaaatcccacagtggaagcaggacgaacactcagagtccttaatttagtagaaaattggttgaacaacaacactcaattttgcataaaagttctcaacccgtatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagggccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgagagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagatcaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6907 - RNA, 9876 nt, synthetic construct
  misc_feature 1..9876: note = derived and/or modified CDS sequence (wt) from DENV-2__FJ410221__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgctggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtaacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtacttgggagtcatggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagagtggtgctgccgatcttgcacactaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcttggaggaaatgcttaggacccgagtaggaacgaaacatgcaatactactagttgcagtttcttttgtgacattgatcacagggaacatgtccttcaaagacctaggaagagtggtggttatggtaggcgctataatggcggatgacataggtataggcgtgacttatcttgccctactagcagccttcaaagttagaccaacttttgcagctggactactcttgagaaagctgacctccaaggaattgatgatgaccaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaacccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcgaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacctatgggaaaggctgaactggaagatggagcctacagaatcaagcaaaaagggattcttggatactctcagatcggagctggagtttacaaagaaggaacatttcatacaatgtggcatgtcacacgtggtgctgttctaatgcacaaaggaaagaggattgaaccttcatgggcggacgtcaaaaaagatctaatatcatatggaggaggctggaagctagaaggagaatggaaagaaggagaagaagtccaggtgctggcactggagcctggaaaaaatccaagagccgtccaaacaaaacctggtcttttcaaaaccaacaccggaacaataggtgccgtatccctggacttttcccctggaacgtcaggatctccaattatcgacaaaaaaggaaaagttgtgggtctttatggtaatggtgttgtcacaaggagtggagcatatgtgagtgctatagcccaatctgaaaaaagtattgaagacaaccccgagatcgaagatgacattttccgaaagagaagactgaccatcatggacctccacccaggagcgggaaagacgaaaagataccttccagccatagtcagagaagccataaaacggggtttgagaacactaatcttggcccccacaagagttgtggcagctgaaatggaggaagctctcagaggacttccaataagataccaaaccccagccatcagagttgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggctggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggccacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggactcctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttctttatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaagatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacgttggaattgaaagtgaaataccaaacctagacataattgggaaaagaatagaaaaaataaagcaagagcatgaaacatcatggcactacgaccaagaccacccatacaaaacatgggcataccatggtagctatgaaacaaaacagactggatcagcatcatccatggtcaacggagtggtcaggctgctgacaaagccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaggccctaggattcttaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggcagaggctattttcaaactaacgtatcaaaacaaggtggtgcgtgtgcaaagaccaacaccaagaggtacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagtcgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagataaaaccccagtggaatcatgggaggaaatcccatacttgggaaaaagagaagaccaatggtgtggctcattgatcgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6908 - RNA, 9876 nt, synthetic construct
  misc_feature 1..9876: note = derived and/or modified CDS sequence (wt) from DENV-2__FJ547064__SS-prME
  source 1..9876: mol_type = other RNA
tctgcaggcatgatcattatgttgattccaacagtgatggcgttccatctaactacacgcaacggagaaccacacatggtcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagacttcgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggtttgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcactgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtatcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcgaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactactataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacagagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacatcttccgaaagagaagactaaccatcatggacctccacccaggagcaggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagacgaagaaagagaaatccctgaacgttcatggaattctggacatgagtgggtcacggattttaaagggaagactgtttggttcgttccaagcataaaagcaggaaatgatatagtagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacattcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaactgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccatggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggcacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgagagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagactacatgccatccatgaaaagattcagaagagaagaggaagaagcaggagtcctgtggtaa

SEQ ID NO: 6909 - RNA, 9876 nt, synthetic construct
  misc_feature 1..9876: note = derived and/or modified CDS sequence (wt) from DENV-2__FJ410223__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggatcttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgatttttattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagtcgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccagccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtaaagttgactatcatgacaggagacatcaaaggaatcatgcaggcaggaaaacgatccttgcggcctcagcccactgagctgaagtattcatggagaacatggggtaaagcaaaaatgctctccacagagtcttataaccaaacctttctcattgatggccccgagacggcagagtgtcccaacacaaatagagcttggaactcgctggaggttgaagactacggctttggagtgttcaccaccaatatatggctaaaattgaaagaaaaacaggatgcattctgcgactcaaaactcatgtctgcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacgttgatcacagggaacatgtccttcaaagacctaggaagagtggtggttatggtaggcgccacaatggcggatgacataggtatgggcgtaacttatcttgccctactagcagccttcaaagttagaccaacttttgcagctgggctactcttgagaaagctgacctccaaggaattgatgatgactaccataggaattgtactcctctcccaaagtactataccagagaccgttcttgaattaactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcactgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaagctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacatcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagaaaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaattataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatctcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactggcacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattagtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggccacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcggggaacttaaaaaatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacagtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgtttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcaagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacccttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggtggcaaatgccatttgctcggcagtgccatcacactgggttccaacaagtcgaacaacctggtccatacacgccaaacatgaatggatgacaacggaagacatgttgacggtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6910 - RNA, 9876 nt, synthetic construct
  misc_feature 1..9876: note = derived and/or modified CDS sequence (wt) from DENV-2__FJ410224__SS-prME
  source 1..9876: mol_type = other RNA
tctgcaggcatgatcattatgctgattccaacagtgatggcgttccatctaaccacacgcaacggagaaccacacatgatcgtcggcatacaggagaaagggaaaagtcttctgttcaaaacagaggatggtgtgaacatgtgcaccctcatggctatggaccttggtgaattgtgtgaagacacagtcacgtacaagtgtcctcttctcaggcagaatgagccagaagacatagactgttggtgcaactccacgtccacgtgggtaacctatgggacctgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgctgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttctaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagctctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacgtggataggaatgaactcacgcagcacctcactgtctgtgtcactagtactggtgggaactgtgacactgtatttgggagttatggtgcaggccgatagtggttgcgttgtgagctggaaaagcaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcagaaaatgaggtgaagttgaccataatgacaggagacattaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctccttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcgggaatagaggaccctctttgagaacaactactgcctcaggaaaactcataacagaatggtgctgccgatcttgcacactaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaactgatgatgactaccataggaattgtactcctctcccaaagtaccataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagctatttttctaacaaccctctcaagaaccaacaagaaaagaagctggccgctaaatgaggctatcatggcagtcggaatggtgagtattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagagcaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagccggagtttacaaagaaggaacatttcatacaatgtggcatgtcacacgtggtgctgttctaatgcacaaaggaaagaggattgaaccttcatgggcggacgtcaaaaaagatctaatatcatatggaggaggctggaagctagaaggagaatggaaggaaggagaagaagtccaggtgctggcactggagcctgggaaaaatccaagagccgtccaaacaaaacctggtcttttcaaaaccaacaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccattatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgccatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcccagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgtttcgatgggattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccaaaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagccacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgatgtcttcttcatcccgccagaaaagtgtgacacattgttgtgtgacataggggagtcatcaccaaatcccactgtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtataacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagcggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaaggccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgctcacaccatttccatgagctaatcatgaaggatggtcgtgtacttgttgttccatgtagaaaccaagatgaactgattggcagagcccgaatctcccaaggagcagggtggtctttgcgggaaacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttggggaaaagagaagaccaatggtgtggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6911 - RNA, 9876 nt, synthetic construct
  misc_feature 1..9876: note = derived and/or modified CDS sequence (wt) from DENV-2__FJ461321__SS-prME
  source 1..9876: mol_type = other RNA
tctgcaggcatgatcattatgctgattccaacagtaatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggagaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcattcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattagagaacctaatgtggaaacaaataacaccagaattaaatcacattctagcagaaaatgaggtgaagttgactattatgacaggagacatcagaggaatcatgcaggcaggaaaacgatccttgcggcctcagcccactgagctaaagtattcatggaaaacatggggcaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaacagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggtcatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccaatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacgaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagctatagtcagagaagccataaaacggggtctgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgatcatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaagtgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactagcgctaaaagagttcaaagaatttgcagccggaagaaagtctctgaccctgaacctaatcacagaaatgggtaggcttccaacattcatgactcagaagacaagagacgcactggataacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttttctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcctgatgtatttccacaggcgtgacctcagactggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6912 - RNA, 9876 nt, synthetic construct
  misc_feature 1..9876: note = derived and/or modified CDS sequence (wt) from DENV-2__FJ410228__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggagaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcatgcggtcggaaatgacacaggaaaacacggcatggaaatcaaagtaacaccacagagttccatcacagaagcagaattgacaggttatggtaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaattccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtacacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattaaatcacattctagcagaaaatgaggtgaagttgactattatgacaggagacatcagaggaatcatgcaggcaggaaaacgatccttgcggcctcagcccactgagctaaagtattcatggaaaacatggggtaaagcaaaaatgctttccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggtcatggtaggcgccacaatggcggatgacataggtatgggcgtgacttatcttgccctactagcagccttcaaagttagaccaacctttgcagctggactactcttgagaaagctgacctccaaggaattgatgatgaccaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattgcaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagttggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccgagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagctcaaactgaaaaaagcattgaagacaaccccgagatcgaagatgacattttccgaaagagaagactgaccatcatggacctccacccaggagcgggaaagacgaaaagataccttccagctatagtcagagaagccataaaacggggtctgagaacactaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgatcatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaattctggacatgagtgggtcacggattttaatgggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaacttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactagcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagtcttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggactaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccttaacagctatagccaaccaagcaacagtgttaatgggtctagggaaaggatggccattgtcaaagatggacatcggagttccccttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaaacaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaagaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcctgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6913 - RNA, 9876 nt, synthetic construct
  misc_feature 1..9876: note = derived and/or modified CDS sequence (wt) from DENV-2__FJ410233__SS-prME
  source 1..9876: mol_type = other RNA
tctgcaggcatgatcattatgctgattccaacagtgatggcgttccatctaaccacacgcaacggagaaccacacatgattgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggattttgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttaatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacctttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggactggataccattagcattgacaatcaagggtctcaacccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggagggagaagaagtccaggtgctggcactggaacctggaaaaaatccaagagccgtccaaacaaaacccggtcttttcaaaaccaacaccggaacaataggtgctgtatccctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacgttaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagttatactaacagatggtgaggagcgggtgattcttgcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatatggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacgcttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccggcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactagtcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcataagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggctatcagtggagatgattgtgttgtgaaacctttagatgacagattcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6914 - RNA, 9876 nt, synthetic construct
  misc_feature 1..9876: note = derived and/or modified CDS sequence (wt) from DENV-2__FJ410237__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcacttgttccacatgtgggaatgggactggagacgcgaaccgaaacatggatgtcatcagaaggggcttggaaacatgcccagagaattgaaacttggatcctgagacatccaggcttcaccataatggcagcaatcctggcatataccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacctgctcttcactggacatctcaagtgcaggttgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgattacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgttcacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgttaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggactttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactacgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcggtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttattcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcattgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataatcgggaaaagaatagaaaaaataaagcaagagcatgaaacatcatggcactacgaccaagaccacccatacaaaacgtgggcataccatggtagctatgaaactaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggaattcggcaaggcaaaaggcagcagagccatatggtacatgtggcttggagctcgcttcctggagtttgaagccctaggattcctaaatgaagatcactggttctctagagagaactctctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggatcgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacgcagattacatgccatccatgaaaagattcagaagagaagaggaagaagcaggagtcctgtggtaa

SEQ ID NO: 6915 - RNA, 9876 nt, synthetic construct
  misc_feature 1..9876: note = derived and/or modified CDS sequence (wt) from DENV-2__FJ410241__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgttgctccttcaatgacaatgcgttgcataggaatatcaaatagagactttgtagaaggggtttcaggaggaagttgggttgacatagttttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgtaagaagaacatggaagggaaaatcgtgcaaccagaaaatttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgcaaaatcccttttgagataatggatttggaaaaaagatacgtcttaggccgcctgatcacagtcaacccaattgtaacagaaaaagacagcccagtcaacatagaagcagaacctccatttggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggattcgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaagacccgagtaggaacgaaacatgcaatactactagttgcagtttcttttgtgacattgatcacagggaacatgtccttcaaagacctaggaagagtggtggttatggtaggcgcaacaatggcggatgacataggtatgggcgtgacttatcttgccctactagcagcctttaaagttagaccaacttttgcagctgggctactcttgagaaagctgacctccaaggaattgatgatgactaccataggaattgtactcctctcccaaagtaccataccagagaccgttcttgaattgactgatgcgttagccttaggcatgatggtccttagaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtctttttaaaaccaacaccggaacaataggtgctgtatctctggacttttcccctggaacgtcaggatctccaattatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagaccagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaactcgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggagggaaatccaggaaggttctggaacactaccattgcggtgtcaatggctaacatctttagagggagttacctggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgaccttggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggccattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatatacagattacatgccatccatgaaaagattcagaagagaagaggaagaggcaggagtcctgtggtaa

SEQ ID NO: 6916 - RNA, 9876 nt, synthetic construct
  misc_feature 1..9876: note = derived and/or modified CDS sequence (wt) from DENV-2__FJ410259__SS-prME
  source 1..9876: mol_type = other RNA
tctgcaggcatgatcatcatgttgattccaacagtaatggcgtttcatctaaccacacgcaacggagaaccacacatgatcgtcggtatacaggagaaagggaaaagtcttctgttcaaaacagaggatggtgtgaacatgtgcaccctcatggctatggaccttggtgaattgtgcgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcatgcggtcggaaatgacacaggaaagcacggcatggagatcaaagtaacaccacagagttccaccacagaagcagaattgacaggttatggcaccgtcacgatggaatgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagtcgtgaaggaaatagcagaaacacaacatggaacgatagtcatcagagtgcaatatgaaggggacggctctccatgtaaaatcccttttgagataatggatctggaaaaaagatatgtcttagggcgcctaatcacagtcaacccaattgtaacagaaaaagatagcccagtcaacatagaagcagaacctccattcggagacagctacatcatcataggagtagagccgggacaactgaaactcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcattgtctgtgtcactagtactggtgggaattgtgacactgtatttgggagtcatggtgcaggccgatagtggttgcgttgtaagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattaaatcacattttagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctgaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagctgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgtacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtctgagaacattaatcttggcccccactagagttgtggcagccgaaatggaggaagctctcagaggacttccaataagataccaaaccccagccatcagagctgagcacactgggcgggaaattgtggatctaatgtgtcatgccacatttaccatgaggctgctatcaccagttagagtgccgaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgttcgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgccccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcctctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaaacaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctgggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcctttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6917 - RNA, 9876 nt, synthetic construct
  misc_feature 1..9876: note = derived and/or modified CDS sequence (wt) from DENV-2__FJ547067__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacacccaggcttcaccataatggcagcaatcctggcttacaccatagggacaacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggacttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacactggtcactttcaaaaatccccatgcgaagaaacaggatgtcgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagttaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccctgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgtggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcaatttcttttgttacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatattggcagcggtgtccgtttccccactgcttttgacatcctcacagcaaaaaacggattggataccattagcattgacaatcaagggtctcaatccaacagctatttttctaacaaccctctcaagaaccaataagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaacaggcagagatatcaggaagcagtccaatcctgtcaataacaatatcagaagatggtagcatgtcgataaaaaatgaagaggaagaacaaacactgaccatacttattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactggacgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgttgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagattgtgcacactggaaagaagccaaaatgctcctagataacattaacacaccagaaggaatcattcctagtatgtttgaaccagaacgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaggcaggtggaagggcgtacaatcatgctctcagtgaactgccggagaccctagagacactgcttttactgacacttctggctacagtcacaggagggatctttttattcttgatgagtgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacctgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttgttggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggccctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccaggtctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttctttatcccgccagaaaagtgtgacacattgttatgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataatcgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggagaaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaagcatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcctacgctcaaatgtggagcttgatgtatttccacaggcgtgacctcaggctggcagcaaatgccatttgctcggcagtgccatcacactgggttccaacaagtcgaacaacctggtccatacacgccaaacatgaatggatgacaacggaagatatgttgacagtctggaacagggtgtggattcgagaaaacccatggatggaagacaaaaccccagtggaatcatgggaggaaatcccatatttgggaaaaagagaagatcaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6918 - RNA, 9876 nt, synthetic construct
  misc_feature 1..9876: note = derived and/or modified CDS sequence (wt) from DENV-2__JN819418__SS-prME
  source 1..9876: mol_type = other RNA
acagcaggcgtgattattatgttgattccaacagccatggcgttccatttaaccacacgtaatggagaaccacacatgatcgttggtaggcaagagaaagggaaaagtcttctgttcaaaacagaggatggtgtgaacatgtgtaccctcatggccatagatcttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgtcccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggtttgtctgcaaacactccatggtagacagaggatggggaaatggatgtggattatttggaaagggaggcattgtgacctgtgctatgttcacatgcaaaaagaacatggaaggaaaagtcgtgctgccagaaaatttggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagacaaagcttggctggtgcatagacaatggttcctagacctgccgttaccatggctacccggagcggacacacaaggatcaaattggatacagaaagagacattggtcactttcaaaaatccccacgcgaagaaacaggatgtcgttgttttaggatctcaagaaggagccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagattccttttgagataatggatttggaaaaaagacatgtcttaggtcgcctgattacagttaacccgatcgtaacagaaaaagatagcccagtcaacatagaagcagaacctccattcggagacagctacatcatcataggagtagagccgggacaattgaaactcaactggtttaagaagggaagttccatcggccaaatgtttgagacaacaatgagaggagcgaagagaatggccattttaggtgacacagcctgggactttggatctctgggaggagtgtttacatctataggaaaggctctccaccaagttttcggagcaatctatggggctgcctttagtggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaataaagaactgaaatgtggcagcgggatcttcatcacagataacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaagcgatctttgcggccccagcccactgagctgaagtactcatggaaaacatggggaaaggcgaaaatgctctccacagagtctcacaaccagacctttctcattgatggccctgaaacagcagaatgccccaacacaaacagagcttggaactcgctggaagttgaagactatggttttggagttttttccaccaatatatggctaaaattgagagaaaaacaggatgtattttgtgactcaaaactcatgtcagcggccataaaagacaacagagccgtccatgccgacatgggttattggatagaaagtgcactcaatgacacatggaagatggagaaagcctctttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaaccacagtggtggtgactgaggactgtggaaatagaggaccctctttaagaacgaccactgcctctggaaaactcataacagaatggtgctgccgatcctgcacattgccacctctaagatacagaggtgaggatggatgctggtacgggatggaaatcagaccattgaaagagaaagaagagaatttggtcaactccttggtcacagccggacatgggcagattgacaacttttcactaggagtcttgggaatggcactgttcctggaagaaatgctcaggacccgagtaggaacgaaacatgcaatactgctagttgcagtatctttcatgacattgattactgggaacatgtcctttagagacctgggaagagtgatggttatggtgggcgctaccatgacggatgacataggtatgggagtgacttatcttgccctactagcagctttcaaagttagaccaacttttgcagctggactgctcttgagaaaactgacctccaaggaattaatgatggccaccataggaatcgcactcctttcccaaagcaccataccagagaccattcttgaactgactgatgcgttagccttgggtatgatggtcctcaaaatagtgagaaatatggaaaagtaccaattggcagtgactatcatggctatctcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgcttaatgaggctatcatggcagtcgggatggtgagcattttagccagttctcttctaaagaatgacattcccatgacaggtccattagtggctggagggctcctcactgtgtgttacgtgctcactggacgatcggccgatttggaactggagagagctgccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggactctttccagtatcgataccaattacggcagcagcatggtacctgtgggaagtgaagaaacaacgggctggagtattgtgggacgtcccttcacccccacccgtgggaaaagccgaactggaagacggagcctatagaatcaagcaaagagggattcttggatattctcagattggagccggagtctacaaagaaggaacattccatacaatgtggcatgtcacacgtggtgctgttctgatgcatagagggaagaggattgaaccatcatgggcagacgttaagaaagacctaatatcatatggaggaggctggaagctagaaggagaatggaaggaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgacagaaaaggaaaagttgtgggtctttatggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggcccccactagagtcgtagcagctgaaatggaggaagctcttagaggacttccaataagataccaaaccccagccatcagagctgagcacaccgggcgggagatcgtggacctaatgtgtcatgccacatttactatgaggctgctgtcaccagtcagagtgccaaattacaacctgatcatcatggacgaagcccacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaattctggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgagggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaagtctttgaccctgaacctaatcacagaaatgggtaggcttccaactttcatgactcagaaggcaagagacgcactggataacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgtataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggcttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtgtccctaacagccattgctaaccaagccacagtactaatgggtcttgggaaaggatggccattgtcaaagatggacatcggagttcccctccttgctattggatgctactcacaagtcaaccctataactcttacagcagctcttcttttattggtggcacattatgccattatagggccaggacttcaagcaaaagcaaccagagaagctcagaaaagagcagcagcaggcatcatgaaaaacccaacagtcgatggaataacagtgattgacctagatccaataccctatgatccaaaatttgaaaagcagttaggacaagtaatgctcctaatcctctgtgtgactcaagtattaatgatgaggactacatgggctctgtgtgaggctctaaccttagcgaccgggcccatctccacactgtgggaaggaaatccagggaggttttggaacactaccattgcagtgtcaatggctaacatctttagagggagctatttggccggagctggacttctcttttccatcatgaagaacacaacaaacacaagaagaggaactggcaacataggagagacacttggagaaaaatggaaaagccgattgaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaaaaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggttcttaacccatatatgccctcagtcatagaaaaaatggaaacactacaaaggaaatatggaggagccttagtgaggaatccactctcacgaaactccacacatgagatgtactgggtatccaatgctaccgggaacatagtgtcatcagtgaacatgatttcaaggatgctgattaacagattcacaatgaaacacaagaaagccacctacgagccagatgttgacctaggaagcggaactcgcaacattggaattgaaagtgagataccaaatctagacataataggaaagagaatagagaaaataaagcaagagcatgaaacatcatggcactatgaccaagaccatccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccttttggacaacaacgcgttttcaaagagaaagtggacacgagaacccaagaaccgaaggaaggcacaaagaaactgatgaaaatcacggcagagtggctttggaaagaactaggaaagaaaaagacacctaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagagaactccctgagtggagtggaaggagaagggctgcacaagctaggctacatcttaagagacgtgagcaaaaaggaagggggagcaatgtacgccgatgatacagcaggatgggacacaagaatcacactagaagacttaaaaaatgaagaaatggtaacaaaccacatggaaggagaacacaagaaactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaatactttcaccaacatggaagcccaattaattagacagatggagggagaaggaatcttcaaaagcattcagcacctgacagtcacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaagaggatggaacgattggacacaagtgcctttctgttcacaccattttcatgagttaatcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgaccttagactggcggctaatgctatttgctcggcagtcccgtcacattgggttccaacaagtcgaacaacctggtccatacacgctaagcatgaatggatgacgacggaagacatgctggcagtctggaatagggtgtggatccaagaaaacccatggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6919 - RNA, 9876 nt, synthetic construct
  misc_feature 1..9876: note = derived and/or modified CDS sequence (wt) from DENV-2__EU482640__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttacgggacatgcaccgccacaggagaacacagaagggaaaaaagatcagtggcactagttccacatgtgggaatgggactggagacacgaactgaaacatggatgtcatcagaaggggcctggaaacatgcccagagaattgaaacttgggtcttgagacatccaggcttcaccataatggcagcaatcctggcttacaccataggaacgacatatttccaaagagtcctgatctttatcttactgacaactgtcgctccttcaatgacaatgcgttgtataggaatatcaaatagagactttgtggaaggggtatcaggaggaagctgggttgacatagtcttggaacatggaagctgtgtgacgacgatggcaaaaaataaaccaacattggattttgaactgataaaaacagaagccaaacaccctgccactctaagaaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgatttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgcaggctgagaatggacaaactacagctcaaaggaatgtcatattccatgtgcacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagttaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggaccatgaaaatcctcataggagtcgtcatcacatggataggaatgaattcacgcagcacctcactgtctgtgtcactagtgttagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggagacaaataacaccagaattgaatcatattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctttccacagagcttcacaaccacacctttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacagcagagccgtccacgccgatatgggttactggatagaaagcgcactcaatgacacatggaagattgagaaagcctcttttattgaagttaagagctgccactggccaaagtcacacactctctggagtaatggagtgctagaaagtgagatgataattccaaagaattttgcaggaccagtgtcacaacacaattacagaccaggctatcatacacaaacggcaggaccctggcatttaggcaggcttgagatggacttcgatttctgcgaaggaaccacagtggtggtgactgaggactgtggaaatagaggaccctctttaagaacaactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgataacttttcactaggagtcttgggaatggcactgttcctggaagagatgctcaggacccgaataggaacgaaacatgcaatattattagttgcagtttctttcgtgacattgatcacagggaacatgtcctttcgagatttggggagagtgatggtcatggtgggcgctactatgacggatgacataggcatgggcgtgacttatctcgccctattagcagccttcaaagtcagaccaacttttgcagctggactactcttaagaaagctgacctccaaggaattgatgatgaccaccataggaatcgtgctcctctcccagagcaccgtaccagagactatacttgaactgactgacgcgttggctttgggaatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacggcagaaagcggattggataccactggcgttgacgatcaaaggcctcaatccaacagccattttcttaacaaccctctcaagaactagcaagaaaaggagctggccactaaatgaggctattatggcagtcgggatggtgagcatcttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagctggagtttacaaagaaggaacatttcacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaagtcctggcattagagcctggaaagaatccaagagccgtccaaacaaaacccggcctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcattgaagacaatccagagattgaagatgacatctttcgaaagaaaagattgaccatcatggacctccacccaggagcaggaaaaacaaagagataccttccagcaatagtcagggaagccataaaacgaggcttgagaacactaatcttggcccccactagagttgtggcggctgaaatggaagaagctctcagaggacttccaataagataccaaaccccagctatcagagctgagcacactgggcgggagattgtggatctaatgtgtcacgccacatttaccatgaggctactgtcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgaagaaagggaaatccctgagcgttcgtggaactctggacatgagtgggttacggattttaaagggaagactgtttggttcgttccaagtataaaagcagggaatgacatagcagcttgcctgagaaagaatggaaagaaagtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgagaatgaccagtacatatacatgggggaacctctggaaaatgacgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtggaaatctggacaaaagaaggagaaaggaagaaactaaaacccagatggttggatgccaggatctactctgacccattggcgctcaaagaattcaaggaattcgcagctggaagaaagtccctgaccctgaatctaatcacagagatgggtaggctcccaaccttcatgacccagaaagcaaggaatgcactggataacttagcagtcttgcatacagctgaagcaggcggaagggcgtataatcatgctcttagtgaactgccggagactctggagacattgcttttactgacactcttggccacagtcacgggcggaatcttcctgttcttgatgagcggaaaaggtatagggaagatgaccctgggaatgtgctgcataatcacggccagtattctcctatggtatgcacaaatacagccacactggatagcagcttcaataatactggagttttttctcatagtcttgctcattccagaaccagaaaaacagagaacaccccaagataatcaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtaaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcctattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgtgtgactcaagtattgatgatgaggactacatgggccttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaactgaccatcacgctgtgtcgcgaggctcggcgaaactgagatggttcgtcgagagaaacctggtcacaccagaagggaaagtagtggaccttggttgtggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttctttactccgccagaaaagtgtgacacattgctgtgtgacataggggagtcgtcaccaaaccccacggttgaagcaggacggacactcagagttttaaacttagtggaaaattggctgaacaataacacccaattttgcataaaggttctcaacccatatatgccctcagttatagaaaaaatggaagcgctacaaaggaaatacggaggagctttggtgaggaatccactctcacgaaattccacacacgagatgtactgggtgtccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgtgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaattaggctacattttaagagacgtgagtaagaaagaaggaggagcaatgtacgccgatgacaccgcaggatgggatacaagaatcacactagaggatttgaaaaatgaagaaatggtgacaaaccacatggaaggagaacacaagaaacttgctgaagccatcttcaaattaacgtaccaaaacaaggtggtgcgcgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccatgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggtttagaagagaagaggaagaggcaggagtcttgtggtag

SEQ ID NO: 6920 - RNA, 9876 nt, synthetic construct
  misc_feature 1..9876: note = derived and/or modified CDS sequence (wt) from DENV-2__EU482641__SS-prME
  source 1..9876: mol_type = other RNA
tctgcaggcatgatcattatgctgattccaacagtaatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccattacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagttgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcatgcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggataagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattaaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggctataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggaacctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtctgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggatttttatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaaccgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaagaaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcctataactctcacagcagccctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccaccttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggtacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacatgccaaacatgaatggatgacaacggaagacatgttgacagtctggaacagggtgtggattcgagaaaacccatggatggaagacaaaactccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6921 - RNA, 9876 nt, synthetic construct
  misc_feature 1..9876: note = derived and/or modified CDS sequence (wt) from DENV-2__EU482642__SS-prME
  source 1..9876: mol_type = other RNA
tctgcaggcatgatcattatgctgattccaacagtgatggcgttccatctaaccacacgtaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgcaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctccttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgtttttgaattgactgatgcgttagccttaggcatgatggtccttaaaatagtaagaaacatggaaaagtatcaattagcagtgactatcatggccatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcagggagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaagggaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgaatgggtcacggattttaaagggaagactgtttggttcgttccaagcataaaagcaggaaatgatatagcagcttgcctgagaaaaaatggaaagaaagtaatacaacttagtaggaagacttttgattccgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctttggaaaatgatgaagactgtgcacactggaaagaagccaaaatgctcctagataacattaacacaccagaaggaatcattcctagtatgtttgaaccagagcgtgaaaaagtggatgccatcgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaatatcctggacatagacctacgccccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacttgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttggcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgatacattgttgtgtgacataggggagtcatcgccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatctaatgcttctgggaacatagtgtcatcagtgaacatgatttcaaggatgttgatcaatagattcacaatgagacacaagaaagccacttacgaaccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattaatgaaaatcacagcagagtggctatggaaagaattagggaagaaaaagacacctaggatatgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactgacgtatcaaaacaaggtggtgcgtgtgcaaagaccaacaccaagaggaacagtaatggacatcatatcgagaaaagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacggcctgtttggggaagtcctacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcaagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6922 - RNA, 9876 nt, synthetic construct
  misc_feature 1..9876: note = derived and/or modified CDS sequence (wt) from DENV-2__EU482643__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagccgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatgaaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgtacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcataacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacacgagtaggaacgaaacatgcaatactactagttacagtttcttttgtgacattgatcacagggaacatgtccttcaaagacctaggaagagtggtggtcatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcttacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatttaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttacggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagctatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagccgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagttacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtctatacacgccaaacatgaatggatgacaacggaagacatgttgacagtctggaacagggtgtggattcgagataacccatggatggaagacaaaaccccagtggaatcatgggaggaaatcccatacttgggaaaaagagaagaccaatggtgcggctcattgattgggttaacaagtagggccacatgggcaaagaacatccaagcagcaataaatcaggttagatctcttatgggcaatgaggaatacacagattacatgccatccatgaaaagattcagaagagaagaggaagaagcaggagtcctgtggtaa

SEQ ID NO: 6923 - RNA, 9876 nt, synthetic construct
  misc_feature 1..9876: note = derived and/or modified CDS sequence (wt) from DENV-2__EU482644__SS-prME
  source 1..9876: mol_type = other RNA
tctgcaggcatgatcattatgctgattccaacagtgatggcgttccatctaaccacacgcaacggagaaccacacatgatcgtcggtatacaggagaaaggaaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccattgggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgtaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccattacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcacacagcactcacaggagccacagaaatccaaatgtcgtcaggaaacttgctcttcactggacatctcaagtgtaggctgagaatggacaagctacagcttaaaggaatgtcatactccatgtgcaccggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtacgggcgtgacttatcttgccctactagcagccttcaaagttagaccaacttttgcagctgggctactcttgagaaagctgacctccaaggaattgatgatgactaccataggaattgtactcctctctcaaagtactataccagagaccgttcttgaattgactgatgcgttagccttaggcatgatggtccttaaaatagtaagaaacatggaaaagtatcaattagcagtgactatcatgactatcttgtgcgtcccaaacgcagtgatattacaaaatgcatggaaagtgagttgcacaatactggcagtggtgtccgtctccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcggcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcacacaatgtggcatgtcacacgtggcgctgttctaatgcataaaggaaagaggattgaaccttcatgggcggacgtcaaaaaagatctaatatcatatggaggaggctggaagctggaaggagaatggaaggaaggagaagaagtccaggtgctggcactggagcctggaaaaaatccaagagccgttcaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtagaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagcgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttgccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctaggaaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaataacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacaaatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6924 - RNA, 9876 nt, synthetic construct
  misc_feature 1..9876: note = derived and/or modified CDS sequence (wt) from DENV-2__EU482645__SS-prME
  source 1..9876: mol_type = other RNA
tctgcaggcatgatcattatgctgattccaacagtgatggcgttccatctaaccacacgcaacggagaaccacacatgatcgtcggtatacaggagaaaggaaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccattgggacgacacatttccagaaagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatctcgttgcccaacacaaggggaacccagcctaaaagaagagcaggataagaggttcgtctgtaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccattacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcacacagcactcacaggagccacagaaatccaaatgtcgtcaggaaacttgctcttcactggacatctcaagtgtaggctgagaatggacaagctacagcttaaaggaatgtcatactccatgtgcaccggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtacgggcgtgacttatcttgccctactagcagccttcaaagttagaccaacttttgcagctgggctactcttgagaaagctgacctccaaggaattgatgatgactaccataggaattgtactcctctctcaaagtactataccagagaccgttcttgaattgactgatgcgttagccttaggcatgatggtccttaaaatagtaagaaacatggaaaagtatcaattagcagtgactatcatgactatcttgtgcgtcccaaacgcagtgatattacaaaatgcatggaaagtgagttgcacaatactggcagtggtgtccgtctccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcggcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcacacaatgtggcatgtcacacgtggcgctgttctaatgcataaaggaaagaggattgaaccttcatgggcggacgtcaaaaaagatctaatatcatatggaggaggctggaagctggaaggagaatggaaggaaggagaagaagtccaggtgctggcactggagcctggaaaaaatccaagagccgttcaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtagaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagcgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttgccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctaggaaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggattaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacaaatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatacttttaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtctggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcgggagtcctgtggtaa

SEQ ID NO: 6925 - RNA, 9876 nt, synthetic construct
  misc_feature 1..9876: note = derived and/or modified CDS sequence (wt) from DENV-2__EU482646__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaataaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcatctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtacttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaacggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaatatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggagggggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctagacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggaaatgggtgaggcagctgggattttcatgacagccactcccccgggaagtagagatccattccctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaggtggatgccattgatggcgaataccgtttgagaggagaagcaaggaaaacatttgtggacttgatgaggagaggagacttaccagtttggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataaccacggctagcatccttctatggtacgcacaaatacagccacactggatagcagcctcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatacatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgctcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6926 - RNA, 9876 nt, synthetic construct
  misc_feature 1..9876: note = derived and/or modified CDS sequence (wt) from DENV-2__EU482647__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgatattcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatgaaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttctaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaatatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcggaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaagctcatgtcggcggccataaaagacaacagagccgtccatgccgacatgggttactggatagaaagtgcactcaatgacacatggaagatagagaaagcctctttcattgaagtaaaaaactgtcactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctcaggaaaactcataacagaatggtgctgccgatcttgcacactaccacccctaagatacagaggtgaagatgggtgctggtacgggatggaaatcagaccattgaaagagaaagaagaaaatctggttaactccttggtcacagccggacatgggcaggttgacaatttttcactgggagtcttgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctacaatggcggatgatataggcatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgtcctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccacccccccaggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatgggattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactccttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaactgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggctttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaagctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaaggccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggaaacggcctgtttggggaagtcttacgcccaaatgtggagcttgatgtatttccacaggcgtgacctcaggctggcggcaaatgccatttgctcagcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6927 - RNA, 9876 nt, synthetic construct
  misc_feature 1..9876: note = derived and/or modified CDS sequence (wt) from DENV-2__EU482648__SS-prME
  source 1..9876: mol_type = other RNA
acagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccggaaaatttggaatacaccatcgtgataacaccccactcaggagaagagcatgctgtaggtaatgacacaggaaaacatggtaaggaaatcaaaataacaccacagagttccatcacagaagcagaactgacaggctatggcacagttacgatggagtgctctccgagaacgggccttgactttaatgagatggtgctgctgcagatggaagacaaagcttggctggtgcacaggcagtggttcctagacctgccgttaccatggctacccggagcggacacacaaggatcaaattggatacagaaagagacactggtcaccttcaaaaatcctcacgcgaagaaacaggatgtcgttgttttaggatctcaagaaggggccatgcacacggcactcacaggggccacagagatccagatgtcatcaggaaacttactattcacaggacatctcaagtgcaggctgagaatggacaaactacagctcaaaggaatgtcgtactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgttttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccatcttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagagcaatacaagttccaaccagaatccccttcaaaattagcttcagctatccagaaagctcatgaagagggcatttgtgggattcgttcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagctcgaaatggactttgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttatgacattgattactgggaacatgtcctttagagacctgggaagagtgatggttatggtgggcgctaccatgacggatgacataggtatgggagtgacttatcttgccctactggcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtcctaaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatctttctaacaactctttcgagaaccagcaagaaaaggagctggccactaaatgaggctatcatggctgtcgggatggtgagcattttagccagttccctcttaaaaaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgttcaaacgaaacctggacttttcaaaaccaacaccggaaccataggcgccgtatctctggacttttctcctggaacgtcaggatccccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcacaccgggcgggagattgtggacctaatgtgtcatgccacgtttactatgaggctgctatcaccagtcagagtgccaaattacaacctgatcatcatggatgaagctcacttcacagacccagcaagcatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgttcgtggaactctggacatgaatgggtcacggattttaaagggaagactgtttggtttgttccaagtataaaagcgggaaatgacatagcagcttgtctcaggaaaaatggaaagaaagtgatacaactcagcaggaagacctttgactctgagtatgttaagactaggaccaatgattgggactttgtggtcacaaccgacatttcagaaatgggtgctaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagatgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggactgggaagcattgcaactcaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgtggtagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactggaaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgaccccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggagccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgctgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagtcacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgagttaatcatgaaagacggccgcgtgcttgtggttccatgcagaaaccaagatgaactgattggcagggcccgaatttctcagggagctgggtggtctttgaaggagactgcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 6928 - RNA, 9876 nt, synthetic construct
  misc_feature 1..9876: note = derived and/or modified CDS sequence (wt) from DENV-2__EU482649__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctatcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagttaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggggccatgcatacagcactcacaggagctacagaaatccaaatgtcgtcaggaaacttgctcttcactggacatctcaagtgcaggctgagaatggacaagctacagcttaaaggaatgtcatactccatgtgcacaggaaagttcaaagttgtgaaggaaatagcagaaacacaacatggaacgatagtcatcagagtgcaatatgaaggggacggctctccatgtaaaatcccatttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccaccgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtatgggatggaaatcagaccattgaaagagaaagaagaaaatctggttaactccttggtcacagccggacatgggcaggttgacaatttttcactaggagtcctgggaatggcattgttcctggaagaaatgcttaggacccgagtaggaacgaaacatgcaatactactagttgcagtttcttttgtgacattgattacagggaacatgtccttcaaagacctaggaagagtggtggttatggtaggcgctacaatggcggatgacataggtatgggcgtgagttatcttgccctactagcagccttcaaagttagaccaacctttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattacaaaatgcatggaaagtgagttgcacaatactggcagtggtgtccgtttccccactgctcttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcagacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacacaggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccgaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagaccgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaataaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactaacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacattggagtcccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccctatgatccaaagtttgaaaagcagttgggacaagtaatgctgctaatcctctgcgtgactcaagtattaatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtggaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagatcacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaagttaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggaaggagaaggagtctttaaaaacatccagaacctgacagtcacagaagaagttgccgtgcaaaactggttggcaagagtggggcgcgaaaggttgtcaagaatggccatcagtggagatgattgtgttgtgaaacctttagatgacaggttcgcaaacgctctgacagccctaaatgacatgggaaagattagaaaagatatacaacaatgggaaccttcaaaaggatggaatgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcggacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6929 - RNA, 9876 nt, synthetic construct
  misc_feature 1..9876: note = derived and/or modified CDS sequence (wt) from DENV-2__EU482650__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctgcagcttaaaggaatgtcatactccatgtgcacaggaaagtttaaagttgtgaaggaaatagcagaaacacaacatggaacgatagtcatcagagtgcaatatgaaggggacggctccccatgcaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagtcgcagtttcttttgtgacattgatcacagggaacatgtccttcaaagacctaggaagagtggtggttatggtaggtgctacaatggcggatgacataggtatgggcgtgacttatcttgccctactagcagcctttaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtaagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagacctaatatcatatggaggaggctggaagctagaaggagaatggaaggaaggagaagaagtccaggtgctggcactggagcctggaaaaaatccaagagccgtccaaacaaaaccaggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacatttttcgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtctgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttctttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagctgggacaagtaatgctactaatcctctgcgtgactcaagtattgatgatgaggactacatgggctctgtgtgaggccttaaccttagctacagggcccatctccacactgtgggaaggaaatccaggaaagttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacacactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggtttgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttatgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgttctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgagagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagatcaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6930 - RNA, 9876 nt, synthetic construct
  misc_feature 1..9876: note = derived and/or modified CDS sequence (wt) from DENV-2__EU482651__SS-prME
  source 1..9876: mol_type = other RNA
tctgcaggcatgatcattatgctgattccaacagtgatggcgttccatctaaccacacgcaacggagaaccacacatgatcgtcggtatacaggagaaggggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagctaaccaacacaacaacagaatcccgttgcccaacacaaggggaacccagcctaaaagaagagcaggataagaggttcgtctgtaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattaacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggggccatgcatacagcactcacaggagctacagaaatccaaatgtcgtcaggaaacttgctcttcactggacatctcaagtgcaggctgagaatggacaagctacagcttaaaggaatgtcatactccatgtgcacaggaaagttcaaagttgtgaaggaaatagcagaaacacaacatggaacgatagtcatcagagtgcaatatgaaggggacggctctccatgtaaaatcccatttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagctctatcggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaaatattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaagattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaataacaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcctgggaatggcattgttcctggaagaaatgcttaggacccgagtaggaacgaaacatgcaatactactagttacagtttcttttgtgacattgattacagggaacatgtccttcaaagacctaggaagagtggtggttatggtaggcgctacaatggcggatgacataggtatgggcgtgacttatcttgccctactagcagccttcaaagttagaccaacctttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattacaaaatgcatggaaagtgagttgcacaatactggcagtggtgtccgtttccccactgcttttgacatcctcacagcaaaaaacggattggataccattagcattgacaatcaagggtctcaacccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatactctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagaccgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagacggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagatgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaagcagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccctatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagatcacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaatgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacattgggttccaacaagtcggacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6931 - RNA, 9876 nt, synthetic construct
  misc_feature 1..9876: note = derived and/or modified CDS sequence (wt) from DENV-2__EU482652__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaattccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagttttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccttgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggattcgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtgaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcttggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtgctataccagagaccgtgcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactagcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaactaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagatttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcacccttttatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagccacagggcccatctccacactgtgggaaggaaatccaggaaggttctggaacactaccatagcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgtacactcagagtccttaatttagtagaaaattggttgaacaacaacactcaattttgcataaaagttctcaatccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagagaagaagctaggggaattcggcaaggcaaaaggcagcagagccatatggtacatgtggcttggagctcgcttcctggagtttgaagccctaggattcctaaatgaagaccactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggctgtcaagaatggccattagtggagatgattgtgttgtgaaacctttagatgacaggttcgcaaacgctttgacagccctaaatgacatgggaaagattagaaaagatatacaacagtgggaaccttcaaaaggatggaatgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacgcagattacatgccatccatgaaaagattcagaagagaggaggaagaagcaggagtcctgtggtaa

SEQ ID NO: 6932 - RNA, 9876 nt, synthetic construct
  misc_feature 1..9876: note = derived and/or modified CDS sequence (wt) from DENV-2__EU482653__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaatatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcagtcggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgttgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatctgggagtcatggtgcaggccgatagtggttgcgttgtgagctggaaaaacaaagaactgaaatgtggcagtgggattttcgtcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcacaaccaaacctttctcattgatggccccgagacggcagagtgccccaacacaaatagagcttggaactcgttggaggttgaagactacggctttggagtgttcaccaccaatatatggctaagattgaaagaaaaacaggatgcattctgcgactcaaaactcatgtcggcggccataaaagacaacagagccgtccatgccgacatgggttactggatagaaagtgcactcaatgacacatggaagatagagaaagcttctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccttctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattggcagtgactatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaacgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggatttttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttacaatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagcaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaactgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagtgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacaaagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagtattgagaattcctcagtgaatgtatccctaacagcaatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacgcaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagttctcaacccatatatgccctcagttatagaaaaaatggaagcactgcagaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctgaatgaagatcactggttctctagagagaactccctgagcggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagcgggcaagttggtacctatggactcaacactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcagactggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaaccaggttagatctcttataggcaatgaggaatacacagattacatgccatccatgaaaagattcagaagagaagaggaagaagcaggagtcctgtggtaa

SEQ ID NO: 6933 - RNA, 9876 nt, synthetic construct
  misc_feature 1..9876: note = derived and/or modified CDS sequence (wt) from DENV-2__EU482654__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcctggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactctatggtagacagaggatggggaaatggatgtggattatttggaaagggaggcatcgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccgggtatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctgcagcttaaaggaatgtcatactccatgtgcacaggaaagtttaaagttgtgaaggaaatagcagaaacacaacatggaacgatagtcatcagagtgcaatatgaaggggacggctccccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagatgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttcttattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggtgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagctttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtctgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacgcttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctttatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgacctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacacactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggtttgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccccatgtcaacatatgggtggaatctggtgcgtcttcagagtggagttgatgtcttcttcatcccgccagaaaagtgtgacacattgttatgtgacataggggagtcatcaccaaatcccacagtggaagcaggacgaacactcagagtccttaatttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaagaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagaccactggttctctagagagaactccctgagtggagtggaaggagaagggctgcacaagctaggttacattctaagagacgtgagcaagaaagagggaggagccatgtacgccgacgacacagcaggatgggacacaagaatcacactggaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgagagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagatcaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6934 - RNA, 9876 nt, synthetic construct
  misc_feature 1..9876: note = derived and/or modified CDS sequence (wt) from DENV-2__EU482656__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtaggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaaactacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgttcacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactggtactggtgggaattgtgacactgtatttgggagtcatggtgcaggccgatagtggttgcgttgtgagctggaaaaacaaagaactgaaatgtggcagtgggattttcgtcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccacacacaaatagcaggaccatggcacctaggtaagcttgagatggactttgatttctgcgatggaaccacagtgatagtgactgaggactgcggaaatagaggaccctctttgagaacaactactgcctctggaaagctcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatctcgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgtgtcccaaacgcagtgatattacaaaatgcatggaaagtgagttgcacaatactggcagtggtgtccgtttccccattgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtagctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatccccaatcatcgacaaaaaaggaaaagttgtgggtctttatggtaatggtgttgtcacaaggagtggagcatacgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacgaggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcttagatgaagaaagagaaatccctgaacgttcatggaattctggacatgagtgggtcacggattttgaagggaagactgtttggttcgttccaagcataaaagccggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttctattcttgatgagcgggaggggcatagggaagatgaccctgggaatgtgctgcataatcacggctagtatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaatgagatgggtttcctagaaaaaacgaagaaggatcttggattaggaagcgttgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgacggaataacagtgattgatctagatccaataccttatgatccaaagtttgaaaaacagttgggacaagtaatgctactaatcctctgcgtgactcaagtattgatgatgaggactacatgggctctgtgtgaggccttaaccttagctacagggcccatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagagaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagcttggggaattcggcaaggcaaaaggcagcagagccatatggtacatgtggcttggagctcgcttcctggagtttgaagccctaggattcttgaatgaagatcactggttctctagagagaactccctgagtggagtggaaggagaagggctgcacaagctaggttacattctaagagacgtgagcaagaaagagggaggagccatgtatgccgacgacacagcaggatgggacacaagaatcacattagaagacctaaaaaatgaagaaatggtaacaaaccacatggaaggggaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctctgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaagaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6935 - RNA, 9876 nt, synthetic construct
  misc_feature 1..9876: note = derived and/or modified CDS sequence (wt) from DENV-2__EU482657__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtctactgttcaaaacagaggatggtgtgaacatgtgcaccctcatggccatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcatgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacctagcctaaaagaagagcaggacaagaggttcgtctgcaaacactccatggtagacagaggatggggaaatggatgtggattatttggaaagggaggcattgtgacctgtgctatgttcacatgtaaaaagaacatggaagggaaaatcgtgcagccagaaaacttggaatacaccattgtggtaacacctcactcaggggaggagcacgcggtcggaaatgacacaggaaaacacggcaaggaaatcaaagtaacaccacagagttccatcacagaagcagaattgacaggttatggtaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcctactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatggaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctgggtaagcttgagatggactttgatttctgcgatggaaccacagtgatagtgactgaggactgcggaaatagaggaccttctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctttcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggatacccttagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcgataacgatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattgatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaactaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgctttgatggaataaagaacaaccaaatcctggaagaaaatgtggaagttgaaatctggacaaaagaaggggaaaggaagaaactgaaacccagatggttggatgctaggatctactctgacccactggcgctaaaagagttcaaagaatttgcagccggaagaaagtctttgaccctgaacctaatcacagaaatgggtaggcttccaacattcatgactcagaagacaagagacgcactggataacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcacccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgatcgatctagatccaataccttatgatccaaagtttgaaaagcagctgggacaagtaatgctactaatcctctgcgtgactcaagtattgatgatgaggactacatgggccctgtgtgaggccttaaccttagctacagggcccatctccacactgtgggaaggaaatccaggaaggttctggaacactaccattgcggtgtcaatggctaacatctttagagggagttacttggctggagctggacttctcttctccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaagcatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaggaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaataaggtggtgcgtgtgcaaagaccaacaccaagaggcacagtaatggacatcatatcgagaagagaccaaagaggtagtgggcaagttggtacctatggactcaataccttcaccaatatggaagcccaattaatcagacagatggagggagaaggagtctttaaaaacatccagcacctgacagtcacagaagaagttgccgtgcataactggttggcaagagtggggcgcgaaaggttatcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgtcccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6936 - RNA, 9876 nt, synthetic construct
  misc_feature 1..9876: note = derived and/or modified CDS sequence (wt) from DENV-2__EU482658__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagccgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttattgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgtacaggaaagtttaaagttgtgaaggaaatagcagaaacacaacatggaacgatagtcatcagagtgcaatatgaaggggacggctctccatgcaaaatcccttttgagataatggatttggaaaaaagatatgtcttaggccgcctgatcacagtcaacccaattgtgacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcataacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacacgagtaggaacgaaacatgcaatactactagttacagtttcttttgtgacattgatcacagggaacatgtccttcaaagacctaggaagagtggtggtcatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcttacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatttaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttacggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagctatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagccgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaagaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcactagagaagaattcacaagaaaggtgagaagcaatgcagccttgggggccatattcaccgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtctatacacgccaaacatgaatggatgacaacggaagacatgttgacagtctggaacagggtgtggattcgagataacccatggatggaagacaaaaccccagtggaatcatgggaggaaatcccatacttgggaaaaagagaagaccaatggtgcggctcattgattgggttaacaagtagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6937 - RNA, 9876 nt, synthetic construct
  misc_feature 1..9876: note = derived and/or modified CDS sequence (wt) from DENV-2__EU482659__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttcttaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcactataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagctctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgtttctggaggaaatgctcaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacacagggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcatcccagaaccagaaaaacagagaacaccccaagacaaccaattgacctacgttgtaatagccatcctcacagtggtggccgcaaccatggcaaacgagatgggtttcctagaaaaaacgaaaaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagctaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaacatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaggaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcgatgaggaatacacagattacatgccatccatgaaaagattcagaagagaagaggaagaagcaggagtcctgtggtaa

SEQ ID NO: 6938 - RNA, 9876 nt, synthetic construct
  misc_feature 1..9876: note = derived and/or modified CDS sequence (wt) from DENV-2__EU482661__SS-prME
  source 1..9876: mol_type = other RNA
tctgcaggcatgatcattatgctgattccaacagtgatggcgtttcatctaaccacacgcaacggagaaccacacatgatcgtcggtatacaggagaaagggaaaagtcttctgttcaaaacagaggatggtgtgaacatgtgcacccttatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcacacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcggaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaagatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacactaccacccctaagatacagaggtgaggatgggtgctggtacgggatggaaatcagaccattgaaagagaaagaagaaaatctggttaactccttggtcacagccggacatgggcaggttgacaatttttcactgggagttttgggaatggcattgttcttggaggaaatgcttaggacccgagtaggaacgaaacatgcaatactactagttgcagtttcttttgtgacattgatcacaggaaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattctagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaaggtgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagtaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaagccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccactgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgtgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacgatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtagtcaggctgctgacaaaaccttgggacgtcctccccacggtaacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttttgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6939 - RNA, 9876 nt, synthetic construct
  misc_feature 1..9876: note = derived and/or modified CDS sequence (wt) from DENV-2__EU482662__SS-prME
  source 1..9876: mol_type = other RNA
acagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaaaggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccggaaaatttggaatacaccatcgtgataacaccccactcaggagaagagcatgctgtaggtaatgacacaggaaaacatggtaaggaaatcaaaataacaccacagagttccatcacagaagcagaactgacaggctatggcacagttacgatggagtgctctccgagaacgggccttgactttaatgagatggtgctgctgcagatggaagacaaagcttggctggtgcacaggcagtggttcctagacctgccgttaccatggctacccggagcggacacacaaggatcaaattggatacagaaagagacactggtcaccttcaaaaatcctcacgcgaagaaacaggatgtcgttgttttaggatctcaagaaggggccatgcacacggcactcacaggggccacagagatccagatgtcatcaggaaacttactattcacaggacatctcaagtgcaggctgagaatggacaaactacagctcaaaggaatgtcgtactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgttttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccatcttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagagcaatacaagttccaaccagaatccccttcaaaattagcttcagctatccagaaagctcatgaagagggcatttgtgggattcgttcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagctcgaaatggactttgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttatgacattgattactgggaacatgtcctttagagacctgggaagagtgatggttatggtgggcgctaccatgacggatgacataggtatgggagtgacttatcttgccctactggcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtcctaaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatctttctaacaactctttcgagaaccagcaagaaaaggagctggccactaaatgaggctatcatggctgtcgggatggtgagcattttagccagttccctcttaaaaaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgttcaaacgaaacctggacttttcaaaaccaacaccggaaccataggcgccgtatctctggacttttctcctggaacgtcaggatccccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcacaccgggcgggagattgtggacctaatgtgtcatgccacgtttactatgaggctgctatcaccagtcagagtgccaaattacaacctgatcatcatggatgaagctcacttcacagacccagcaagcatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgttcgtggaactctggacatgaatgggtcacggattttaaagggaagactgtttggtttgttccaagtataaaagcgggaaatgacatagcagcttgtctcaggaaaaatggaaagaaagtgatacaactcagcaggaagacctttgactctgagtatgttaagactaggaccaatgattgggactttgtggtcacaaccgacatttcagaaatgggtgctaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagatgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggactgggaagcattgcaactcaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgtggtagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactggaaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgaccccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggagccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgctgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagtcacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgagttaatcatgaaagacggccgcgtgcttgtggttccatgcagaaaccaagatgaactgattggcagggcccgaatttctcagggagctgggtggtctttgaaggagactgcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 6940 - RNA, 9876 nt, synthetic construct
  misc_feature 1..9876: note = derived and/or modified CDS sequence (wt) from DENV-2__EU482663__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaactgtgtgaagacacaatcacgtacaagtgtcctcttctcaggcagaatgagccagaagacatagactgttggtgcaactccacgtccacgtgggtaacctatgggacctgtaccactacgggagagcatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagacttcgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaatttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctaccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaaccacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgtattctgcgactcaaaactcatgtcggcggccataaaagacaacagagccgtccatgccgacatgggttactggatagaaagtgcactcaatgacacatggaagatagagaaagcctccttcatcgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtagctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggaacctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagatgacattttccgaaagagaagactgaccatcatggatctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctttgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggtatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggatatagacctacgtcccgcatcagcttggacgctgtatgccgtggctacaacatttgttacaccaatgctgagacatagcattgagaattcctcagtgaatgtatccctaacagctatagccaatcaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatttccacactgtgggaaggaaatccaggaaggttctggaacactaccattgcagtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaagaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttatgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaatggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaagtgagaagcaatgcagccttgggggccatattcactgatgagaacaagtggaagtcggcacgtgaggctgttgaagatagtaggttttgggagttggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaacgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccagttaatcagacagatggagggagaaggagtctttaaaaacatccagcacctgacagtcacagaagaagttgccgtgcaaaactggttggcaagagtggggcgcgaaaggttgtcaagaatggccatcagtggagatgactgtgttgtgaaacctttagatgacaggttcgcaaacgctttgacagccctaaatgacatgggaaagattagaaaagatatacagcagtgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtcccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacatagattacatgccatccatgaaaagattcagaagagaagaggaagaagcaggagtcctgtggtaa

SEQ ID NO: 6941 - RNA, 9876 nt, synthetic construct
  misc_feature 1..9876: note = derived and/or modified CDS sequence (wt) from DENV-2__EU482664__SS-prME
  source 1..9876: mol_type = other RNA
acagcaggcgtgattattatgttgattccaacagcgatggcgttccatcttaccacacgcaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggcatgggactggagacacgaactgaaacatggatgtcatcagaaggagcctggaaacacgctcagagaattgaaacctggatcttgagacatccaggctttactataatggcagcaatcctggcatacaccataggaacgacacattttcaaagggccctgattttcatcttactgacagctgtcgctccttcaatgacaatgcgttgcataggaatatcaaatagagactttgtagagggggtttcaggaggaagctgggttgacatagttttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcaaccagaaaatttggaatacaccatcgtgataacacctcactcaggagaagagcatgctgtaggtaatgacacaggaaaacatggtaaggaaatcaaaataacaccacagagttccatcacagaagcagaactgacaggctatggcacagttacgatggagtgctctccgagaacgggcctagactttaatgagatggtgctgctgcagatggaagacaaagcttggctggtgcacaggcagtggttcctagacctgccgttaccatggctacccggagcggacacacaaggatcaaattggatacagaaagagacactggtcactttcaaaaatccccacgcgaagaaacaggatgtcgttgttttaggatcccaagaaggggccatgcacacggcactcacaggggccacagaaatccagatgtcatcaggaaacttactattcacaggacatctcaagtgcaggctgagaatggacaaactacagcttaaaggaatgtcatactctatgtgcacaggaaagtttaaaattgtgaaggaaatagcagaaacacaacatggaacaatagttattagagtacaatatgaaggagacggctctccatgtaagatcccttttgaaataatggatttagaaaaaagacatgtcttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccattttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcggaatcttcatcacagataacgtgcacacatggacagaacaatacaagttccaaccagaatccccttcaaaattagcttcagctatccagaaagctcatgaagagggcatttgtggaattcgctcagtaacaagattggagaatctgatgtggaaacaaataacaccagaattgaaccacattctatcagaaaatgaggtaaagttgaccatcatgacaggagacattaaaggaatcatgcaggcaggaaaacgatccctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttctgtgactcaaaactcatgtcagcagccataaaagacaacagagccgtccatgccgatatgggttactggatagaaagcgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagcttgaaatggactttgatttctgcgaaggaactacagtggtggtgactgaggactgcggaaatagaggaccctctttaagaacgaccactgcctctggaaaactcataacagaatggtgctgccgatcctgcacattaccacctctaagatatagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttgtgacattgattactgggaacatgtcctttagagacctgggaagagtgatggttatggtgggcgctaccatgacggatgacataggcatgggagtgacttatcttgccctactagcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgcttttaacatcctcacagcagaaagcggattggataccactggcattgacgataaaaggtctcaatccaacagccatttttctaacaactctttcgagaaccagcaagaaaaggagctggccgctaaatgaggctatcatggctgtcgggatggtgagcattttagccagttctctcttaaagaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcttggcattggaacctggaaaaaatccaagagctgtccaaacgaaacctggacttttcaaaaccaacaccggaaccataggcgccgtatctctggacttttctcctggaacgtcaggatctccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgaccatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcataccgggcgggagattgtggacctaatgtgtcatgccacgtttactatgaggctgctatcaccagtcagagtgccaaactacaacctgatcatcatggatgaagctcacttcacagacccagcaagtatagcagctagaggatacatttcaactcgagtagagatgggagaagcagctgggattttcatgacagctactcctccgggaagtagagacccatttcctcagagcaatgcaccaatcatagatgaggaaagagaaatccctgagcgctcgtggaactctggacatgaatgggtcacggattttaaagggaagactgtttggtttgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaaaccagttatactaacagatggtgaagagcgggtgatcttggcaggacccatgccagtaacccactctagtgcagcacaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaattattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaacaaccaaatactggaagaaaacgtggaagtggaaatttggacaaaagaaggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagacgcactggataacctagctgtgctgcacacggctgaggcgggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgtgctgcataatcacggctagcatcctcctatggtatgcacagatacaaccacactggatagccgcttcaataatattggaattttttctcatagttttgctcattccagaaccagaaaaacagagaacaccccaagataaccaattgacttacgttgtcatagccatcctcacagtagtggccgcaaccatggcaaacgaaatgggttttctggaaaaaaccaagaaagacctcggattgggaagcgttgcaacccaggaacctgagagcaacattctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcataatgaaaaacccaacagtcgatggaataacagtgatcgacctagatccaataccctatgatccaaaatttgaaaagcagttgggacaagtaatgctcctaattctctgcgtgactcaagtattaatgatgaggactacatgggctctgtgtgaggctctaaccttagcgaccgggcccatctccacattgtgggaaggcaatccagggaggttttggaacacaaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctgagcttggtggaaaattggttgaacaatgacacccaattttgcataaaggttctcaatccatacatgccctcagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagctacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgactccatttggacaacaacgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagttacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccctcaaaaggatggaacgattggacacaagtgcctttttgttcacaccattttcatgagttaatcatgaaagacggccgtgtgcttgtggtcccatgcagaaaccaagatgaactgattggcagggcccgaatttcccagggagctgggtggtctttgaaggagacggcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacacgaatggatgacgacggaagacatgctgacagtctggaacagggtgtggatccaagaaaacccatggatggaagataaaactccagtggagtcatgggaggaagtcccatatttgggaaaaagagaagaccaatggtgcggctcattgattgggctaacaagcagggctacctgggcaaagaatatccaaacagcaataaatcaagtcagatcccttataggcaatgaagaatacacagattacatgccatccatgaagagattcagaagggaagaggaagaggcaggtgtcctgtggtag

SEQ ID NO: 6942 - RNA, 9876 nt, synthetic construct
  misc_feature 1..9876: note = derived and/or modified CDS sequence (wt) from DENV-2__EU482665__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaactgtgtgaagacacaatcacgtacaagtgtcctcttctcagacagaatgagccagaagacatagactgttggtgcaactccacgtccacgtgggtaacctatgggacctgtaccactacgggagagcatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaatttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaaccacattctagcagaaaatgaggtgaagttgactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctccttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggactcgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccattttcctaacaaccctctcaagaaccaacaagaaaagaagctggccactaaatgaggctatcatggcagtcggaatggtgagcattttagccagttccctcctaaaaaatgatattcccatgacaggaccactagtagctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagttagaaggagaatggaaggaaggagaagaagtccaggtgctggcactggagcctggaaaaaatccaagagccgtccaaacaaaacctggtcttttcaaaaccaacaccggaacaataggtgccgtatctttggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagatgacattttccgaaagagaagactgaccattatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtcattgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggatatagacctacgtcccgcatcagcttggacgctgtatgccgtggctacaacattcgttacaccaatgctgagacatagcattgagaattcctcagtgaatgtatccctaacagccatagccaatcaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatttccacactgtgggaaggaaatccaggaaggttctggaacactaccattgcagtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaagtgagaagcaatgcagccttgggggccatattcactgatgagaacaagtggaagtcggcacgtgaggctgttgaagatagtaggttttgggagttggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagttcgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaacgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagctcaattaatcagacagatggagggagaaggagtctttaaaaacatccagcacctgacagtcacagaagaagttgccgtgcaaaactggttggcaagagtggggcgcgaaagattgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6943 - RNA, 9876 nt, synthetic construct
  misc_feature 1..9876: note = derived and/or modified CDS sequence (wt) from DENV-2__EU482666__SS-prME
  source 1..9876: mol_type = other RNA
acagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgtcccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccggaaaatttggaatacaccatcgtgataacacctcactcaggagaagagcatgctgtaggtaatgacacaggaaaacatggtaaggaaatcaaaataacaccacagagttccatcacagaagcagaactgacaggctatggcacagttacgatggagtgctctccgagaacgggccttgactttaatgagatggtgctgctgcagatggaagacaaagcttggctggtgcacaggcagtggttcctagacctgccgttaccatggctacccggagcggacacacaaggatcaaattggatacagaaagagacactggtcaccttcaaaaatcctcacgcgaagaaacaggatgtcgttgttttaggatctcaagaaggggccatgcacacggcactcacaggggccacagagatccagatgtcatcaggaaacttactattcacaggacatctcaagtgcaggctgagaatggacaaactacagctcaaaggaatgtcgtactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgttttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccatcttaggtgacacagcctgggattttggatccctaggaggagtgtttacatctataggaaaagctctccaccaagttttcggagcaatctatggggctgcctttagtggggtctcatggaccatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagagcaatacaagttccaaccagaatccccttcaaaattagcttcagctatccagaaagctcatgaagagggcatttgtgggattcgttcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcataaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctatcacacgcaaacagcaggaccttggcatctaggtaagcttgaaatggactttgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttatgacattgattactgggaacatgtcctttagagacctgggaagagtgatggttatggtgggcgctaccatgacggatgacataggtatgggagtgacttatcttgccctactagcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtcctaaaaataatgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatctttctaacaactctttcgagaaccagcaagaaaaggagctggccgctaaatgaggctatcatggctgtcgggatggtgagcattttagccagttccctcttaaaaaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgttcaaacgaaacctggacttttcaaaaccaacaccggaaccataggcgccgtatctctggacttttctcctggaacgtcaggatccccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcacaccgggcgggagattgtggacctaatgtgtcatgccacgtttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgttcgtggaactctggacatgaatgggtcacggattttaaagggaagactgtttggtttgttccaagtataaaagcgggaaatgacatagcagcttgtctcaggaaaaatggaaagaaagtgatacaactcagcaggaagacctttgactctgagtatgttaagactaggaccaatgattgggactttgtggtcacaaccgacatttcagaaatgggtgctaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagatgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtggggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggactgggaagcattgcaactcaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttaggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgtggtagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactggaaacatagtgtcatcagtgaacatgatttcaaggatgctgattaacagattcacaatgaaacacaagaaagccacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagaccggatcagcatcatccatggtgaacggagtggtcagactactgacaaaaccttgggacgtcgtccctatggtaacacagatggcaatgacagatacgaccccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggagccatattcactgatgagaacaaatggaagtcggcacgcgaggctgttgaagatagcaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagtcacagaagaaattgctgtacaaaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgagttaatcatgaaagacggccgcgtgcttgtggttccatgcagaaaccaagatgaactgattggcagggcccgaatttctcagggagctgggtggtctttgaaggagactgcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 6944 - RNA, 9876 nt, synthetic construct
  misc_feature 1..9876: note = derived and/or modified CDS sequence (wt) from DENV-2__EU482667__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaactgtgtgaagacacaatcacgtacaagtgtcctcttctcaggcagaatgagccagaagacatagactgttggtgcaactccacgtccacgtgggtaacctatgggacctgtaccactacgggagagcataggagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaatttagaatacaccattgtggtaacacctcactcaggggaggagcatgcggtcggaaatgacacaggaaaacacggcaaggaaatcaaagtaacaccacagagttccatcacagaagcggaattgaccggttatggtaccgtcacgatggagtgctccccgagaacaggcctcgacttcaatgagatggtgttgctgcagatggaaaataaagcttggctggtgcataggcaatggtttctagacctaccattaccatggctgcccggagcggataaacaagagtcaaattggatacagaaagaagcattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcaaagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaaccacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgtattctgcgactcaaaactcatgtcggcggccataaaagacaacagagccgtccatgccgacatgggttactggatagaaagtgcactcaatgacacatggaagatagagaaagcctccttcattgaggtaaaaaactgccactggccaaaatcacacaccctctggagtaatggagtgctagaaagtgagatgataatcccaaagaatctcgctggaccagtgtctcaacacaactatagaccaggttaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtagctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagacgacattttccgaaagagaagactgaccatcatggatctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctactatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctttgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggatatagacctacgtcccgcatcagcttggacgctgtatgccgtggctacaacattcgttacaccaatgctgagacatagcattgagaattcctcagtgaatgtatccctaacagctatagccaatcaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaggcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatttccacactgtgggaaggaaatccaggaaggttctggaacactaccattgcagtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaagtgagaagcaatgcagccttgggggccatattcactgatgagaacaagtggaagtcggcacgtgaggctgttgaagatagtaggttttgggagttggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaacgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctctcataggcaatgaggaatacacagattacatgccatccatgaaaagattcagaagagaagaggaagaagcaggagtcctgtggtaa

SEQ ID NO: 6945 - RNA, 9876 nt, synthetic construct
  misc_feature 1..9876: note = derived and/or modified CDS sequence (wt) from DENV-2__EU482668__SS-prME
  source 1..9876: mol_type = other RNA
tctgcaggcatgatcattatgctgattccaacagtaatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagagaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcatgcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggttcctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactatctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcggtaacaagattggagaacctaatgtggaaacaaataacaccagaattaaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaatagaggaccctctttgagaacgactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagccgccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagctgcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggaacctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtctgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgatcatcatggacgaagcccatttcacagacccagcaagtatagcagctagaggatacatctcaacccgagtggaaatgggtgaagcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaacgtatccctaacagctatagccaaccaagcaacagtgttaatgggtctagggaaaggatggccattgtcaaagatggacatcggagttccccttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaaatcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgctttctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaacactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctctgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6946 - RNA, 9876 nt, synthetic construct
  misc_feature 1..9876: note = derived and/or modified CDS sequence (wt) from DENV-2__EU482669__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccgcgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagctaaccaacacaacaacagaatcccgttgcccaacacaaggggaacccagcttaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagtagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggagccatgcatacagcactcacaggagctacagaaatccaaatgtcatcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccatttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtatcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagaaggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaattgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaagaaatgcttaggacccgagtaggaacgaaacatgcaatactactagttgcagtttcttttgtgacattgattacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacatcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattataaagggaagaccgtttggttcgttccaagcataaaagcaggaaatgatatagcagcttgcctgagaaaaaatgggaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgctttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggcaggcttccaacattcatgactcagaagacaagagacgcactggacaacctagcagtgctgcacacggctgaagcaggtggaagagcgtataatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggtatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctggaaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagatcacccatacaaaacgtgggcataccatggtagctatgaaacaaaacagactggatcagcatcatccatggtcaacggagtggtcaggctgctgacaaaaccttgggacgtcctccccacggtgacacagatggcgatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaataagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggagggagaaggagtctttaaaaccatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcggacaacctggtccatacacgccaaacatgaatggatgacaacggaagacatgttgacagtctggaatagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctatggtaa

SEQ ID NO: 6947 - RNA, 9876 nt, synthetic construct
  misc_feature 1..9876: note = derived and/or modified CDS sequence (wt) from DENV-2__EU482670__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaattacgtacaagtgtcctcttctcaggcagaatgagccagaagacatagactgttggtgcaactccacgtccacgtgggtaacctatgggacctgtaccactacgggagaacatagaagagaaaaaagatcagtggcacttgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgctgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtacaaccagaaaacttggaatacaccattgtggtaacacctcactcaggggaggagcatgcggtcggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgctgcagatggaaaataaagcttggctggtgcatagacaatggtttctagacctgccattaccatggctgcccggagcggataaacaagagtcaaattggatacagaaagaaacattggtcactttcaaaaatccccatgcgaagaaacaagatgttgttgttttaggatcccaagaaggggccatgcatacagcactcacaggagctacagaaatccaaatgtcgtcaggaaacttgctcttcactggacatctcaagtgcaggttgagaatggacaagctacagcttaaaggaatgtcatactccatgtgcacaggaaagtttaaagtcatgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatccataggaaaagctctccaccaagtctttggagcaatctatggagctgccttcagtggggtatcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaattagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcataaccaaacttttctcattgatggccccgagacggcagagtgccccaacacaaatagagcttggaactcgttggaggttgaagactacggctttggagtgttcaccaccaatatatggctaaaattgaaagaaaaacaggatgcattctgtgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagcaatggagtgctagaaagtgagatgataatcccaaagaatctcgctggaccagtgtctcaacacaactatagaccaggctaccatacacaagtagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtctccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaggtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctattctgacccactggcgctaaaagagttcaaagaatttgcagccggaagaaagtctctgaccctgaacctaatcacagaaatgggtaggcttccaacatttatgactcagaagacaagagacgcactggacaacctagcggtgctgcacacggccgaagcaggtggaagggcatacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagaaaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttaaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcattacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagcccgcttcctggagtttgaagccctaggattcctgaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaataaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtatacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6948 - RNA, 9876 nt, synthetic construct
  misc_feature 1..9876: note = derived and/or modified CDS sequence (wt) from DENV-2__EU482671__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagttttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcatctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgagggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaagtcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtgtctctagacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccattccctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaggtggatgccattgatggcgaataccgtttgagaggagaagcaaggaaaacatttgtggacttgatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgtataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcactatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagacagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtgatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgctgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgcagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6949 - RNA, 9876 nt, synthetic construct
  misc_feature 1..9876: note = derived and/or modified CDS sequence (wt) from DENV-2__EU482674__SS-prME
  source 1..9876: mol_type = other RNA
tctgcaggcatgatcattatgctgattccaacagtgatggcgtttcatctaaccacacgcaacggagaaccacacatgatcgtcagtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacacagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagccgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaattgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcaccttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccttgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgtgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaacagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggaatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgttacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggacattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaaacattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattcagagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaatcaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcacgctctcagtgaactgccggagaccctagagacactgcttttactgacacttctggctacagtcacaggagggatctttttattcttgatgagcgggaggggcatagggaagatgaccttgggaatgtgctgcataatcacggctagcatccttctatggtacgcacagatacagccacactggatagcagcttcaataatactggagttttttctcatagttttacttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccttaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcctatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccttcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaaaaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgactggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6950 - RNA, 9876 nt, synthetic construct
  misc_feature 1..9876: note = derived and/or modified CDS sequence (wt) from DENV-2__EU482676__SS-prME
  source 1..9876: mol_type = other RNA
tctgcaagcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaactgtgtgaagacacaatcacgtacaagtgtcctcttctcaggcagaatgagccagaagacatagactgttggtgcaactccacgtccacgtgggtaacctatgggacctgtaccactacgggagagcatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagacttcgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcataaaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggagaatcgtgcaaccagaaaatttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaaccacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgtattctgcgactcaaaactcatgtcggcggccataaaagacaacagagccgtccatgccgacatgggttactggatagaaagtgcactcaatgacacatggaagatagagagagcctccttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcatctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtagctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaagctgaactggaagatggagcctacagaatcaagcaaaaagggattcttggatattctcagatcggagctggagtttacaaagaaggaacattccatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagatgacattttccgaaagagaagactgaccatcatggatctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttactatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagcatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctttgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggtatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggatatagacctacgtcccgcatcagcttggacgctgtatgccgtggctacaacatttgttacaccaatgctgagacatagcattgagaattcctcagtgaatgtatccctaacagctatagccaatcaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatttccacactgtgggaaggaaatccaggaaggttctggaacactaccattgcagtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaagaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactgatgaaaatcacagcagagtggctgtggaaagaattagggaagaaaaagacacctaggatgtgcaccagagaagaattcacaagaaaagtgagaagcaatgcagccttgggggccatattcactgatgagaacaagtggaagtcggcacgtgaggctgttgaagatagtaggttttgggagttggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaacgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccagttaatcagacagatggagggagaaggagtctttaaaaacatccagcacctgacagtcacagaagaagttgccgtgcaaaactggttggcaagagtggggcgcgaaaggttgtcaagaatggccatcagtggagatgactgtgttgtgaaacctttagatgacaggttcgcaaacgctttgacagccctaaatgacatgggaaagattagaaaagatatacagcagtgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtcccatcacactgggttccaacaagtcgaacaacctggtccatacacgccaaacatgaatggatgacaacggaagacatgttggcagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6951 - RNA, 9876 nt, synthetic construct
  misc_feature 1..9876: note = derived and/or modified CDS sequence (wt) from DENV-2__EU482677__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtccataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaactatagtcatcagagtgcaatatgaaggggacggctctccatgtaaaatcccttttgaaataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcgtcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcagaaaatgaggtgaagttgactattatgacaggagacattaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacactaccacccctaagatacagaggtgaggatgggtgctggtacgggatggaaatcagaccattgaaagagaaagaagaaaatctggttaactccttggtcacagccggacatgggcaggttgacaatttttcactgggagtcctgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttctgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctgggaaaaatccaagagccgtccaaacaaaacctggtcttttcaaaaccagcaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcacatttcacagacccagcaagtatagcagctagaggatacatctcaacccgagtggaaatgggtgaggcagctgggattttcatgacagccactcccccgggaagcagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactaaaaccaatgactgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatgggattaagaacaaccaaatcctggaagaaaatgtggaagttgaaatctggacaaaagaaggggaaaggaagaaattgaaacccagatggttggatgccaggatctactctgacccactggcgctaaaagagttcaaagaatttgcagccggaagaaagtctctgaccctgaacctaatcacagaaatgggtaggcttccaacattcatgactcagaaggcaagagacgcactggacaacctagcagtgctgcacacggctgaagcaggtggaagggcgtacaatcatgctctcagtgaactgccggagaccctagagacactgcttttactgacacttctggctacagtcacaggaggaatctttttattcttgatgagcgggaggggcatagggaagatgaccctgggaatgtgctgcataatcacggctagcatccttttatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattacgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacatggtcacaccagaagggaaagtagtggacctcggttgtggcagaggaggctggtcatattattgcggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaaatgaaagtgaaataccaaacctagacataattgggaaaagaatagaaaaaataaagcaagagcatgaaacatcatggcactacgaccaagaccacccatacaaaacgtgggcatatcatggtagctatgaaacaaaacagactggatcagcatcatccatggtcaacggagtggtcaggctgctgacaaaaccttgggacgtcctccctacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaagctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccagagaggtagtgggcaagttggcacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgactgtgttgtgaaacctttagacgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacggcttgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6952 - RNA, 9876 nt, synthetic construct
  misc_feature 1..9876: note = derived and/or modified CDS sequence (wt) from DENV-2__EU482678__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaagaaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggatgaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtatctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgtttctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattggcaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaatactggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgttaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggctacattctaagagacgtgagcaagaaagagggaggagccatgtacgccgacgacacagcaggatgggacacaagaatcacactagaagacctaaaaaatgaagaaatggtaacaaaccacatgaaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtttttaaaaacatccagcacctgacagtcacagaagaagttgccgtgcaaaactggttggcaagagtggggcgcgaaaggttgtcaagaatggccatcagtggagatgattgtgttgtgaaacctttagatgacaggtttgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacttggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6953 - RNA, 9876 nt, synthetic construct
  misc_feature 1..9876: note = derived and/or modified CDS sequence (wt) from DENV-2__EU482679__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccttaaggaagtactgcatagaagcaaagctaaccaacacaacaacagaatcccgttgcccaacacaaggggaacccagcctaaaagaagagcaggataagaggttcgtctgtaaacactccatggtagacagaggatggggaaatggatgtggattatttggaaagggaggcattgtgacctgtgctatgttcacatgcaaaaagaacatggaagggaaaatcgtgcaaccagaaaacttagaatataccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggacgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggtgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggcttctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggacttttccctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatactctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccaattagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaacgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaattcgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagtgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaatccaaccgtcgatggaataacagtgattgatttagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacaccaccattgcggtgtcaatggccaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactactgtggaggactaaaaaacgtaagagaagtgaaaggcctaacaaaaggaggaccaggacacgaagaacccatccctatgtcaacatatgggtggaatttggtgcgtcttcagagtggagttgacgtcttcttcatcccgccagaaaagtgtgacacattgttgtgtgacataggggagtcatcaccaaatcccacagtagaagcaggacgaacactcagagtccttaatttagtagaaaattggttgaacaacaacactcaattttgcataaaagttctcaacccatacatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagctacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatataaaacgtgggcataccatggtagctatgaaacaaaacagactggatcagcatcatccatggttaacggagtggtcaggctgctgacaaaaccttgggatgtcctccccacggtgacacagatggcaatgacagatacgactccatttggacaacagcgtgtttttaaagaaaaagtggacacgagaacccaagaaccgaaagaaggcacgaagaaattaatgaaaatcacagcagagtggctgtggaaagaattagggaagaaaaagacacctaggatgggcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggtttcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcagaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccgtacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6954 - RNA, 9876 nt, synthetic construct
  misc_feature 1..9876: note = derived and/or modified CDS sequence (wt) from DENV-2__EU482774__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccttggctgcccggagcggataaacaagagtcgaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcttcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccagccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgaccattatgacaggagacatcaaaggaatcatgcaggcaggaaaacgatctttgcggcctcagcccactgagctaaagtattcatggaaaacatggggtaaagcaaaaatgctctccacagagtctcataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaagaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattctagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacagcagcagcatggtatctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagctcaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaataacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaaacaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcaaagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagatcaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6955 - RNA, 9876 nt, synthetic construct
  misc_feature 1..9876: note = derived and/or modified CDS sequence (wt) from DENV-2__EU482775__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaactacagtgatagtgactgaggactgcggaaatagaggaccctctttgagaacaactactgcctctggaaaactcataacagaatggtgctgccgatcttgcacattgccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtgggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgttacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatttcaggactttttcctatatcaataccaatcacggcagcagcatggtacttgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcagaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaggtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6956 - RNA, 9876 nt, synthetic construct
  misc_feature 1..9876: note = derived and/or modified CDS sequence (wt) from DENV-2__EU482776__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgcgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcttaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcagataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagctctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtatgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagcctacaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagcgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatacggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacctaccagtctggctggcttacaaagtggcagctgaaggcatcaactatgcagacagaaggtggtgttttgatggaattaagaacaaccaaatcctggaagaaaatatggaagttgaaatctggacaaaggaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacgagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggtatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggccaacatctttagagggagttacttggctggagctggacttctcttttccattatgaagaacacaaccaacacaagaaggggaactggcaacataggagagacgcttggagagaaatggaaaagccgattgaacgcactggggaaaagtgaattccagatctacaagaaaagtggaatccaggaagtggatagaaccttggcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaatgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagaatccttaatttagtagaaaattggttgaacaacaacactcaattttgcataaaagttctcaacccatatatgccctcagttatagaaaaaatggaagcactgcaaaggaaatatggaggagccttagtgagaaatccactctcacgaaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaagcatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggtgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcacgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattctagaaaacccatggatggaagacaaaaccccagtggaatcatgggaggaaatcccatacttgggaaaaagagaagaccaatggtgcggctcattgattgggttaacaagcagggccacttgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6957 - RNA, 9876 nt, synthetic construct
  misc_feature 1..9876: note = derived and/or modified CDS sequence (wt) from DENV-2__EU482777__SS-prME
  source 1..9876: mol_type = other RNA
tctgcaggtatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacaaaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcattataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaatcgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacataccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaactacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagtcagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagctagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtaacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgccctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagcactcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcgaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaacctggtgcgtctccagagtggagttgacgtcttcttcatcccgccagaaaagtgtgacacattgttgtgtgacataggggagtcatcgccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgctaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6958 - RNA, 9876 nt, synthetic construct
  misc_feature 1..9876: note = derived and/or modified CDS sequence (wt) from DENV-2__EU482778__SS-prME
  source 1..9876: mol_type = other RNA
acagcaggcgtgattattatgttaattccaacagcgatggcgttccatttaaccacacgtaatggagaaccacacatgatcgttggcagacaagagaaagggaaaagtcttctgtttaaaacagaggatggtgtgaacatgtgtaccctcatggccattgatcttggtgaattgtgtgaagatacaatcacgtacaagtgccccctcctcaggcagaatgaaccagaagatatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggattttgagacatccaggctttaccataatggcagcaatcctggcatacaccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgcgtgacgacaatggcaaaaaacaaaccaacattggattttgaactgataaaaactgaagccaaacaacctgccactctaaggaagtactgtatagaggcaaagctgaccaatacaacaacagaatctcgttgcccaacacaaggggaacccagtctaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctcctttcggagacagctacatcattataggagtagagccgggacaattgaaactcaactggttcaagaaaggaagttccatcggccaaatgtttgagacaacaatgagaggagcaaagagaatggctattttaggtgacacagcctgggattttggatctctgggaggagtgtttacatctataggaaaggctctccaccaagttttcggagcaatctatggggccgcctttagcggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtaagctggaaaaacaaagaactgaaatgtggcagcgggatcttcatcacagataacgtgcatacgtggacagaacaatacaagttccaaccagaatccccttcaaaattagcttcagctatccaaaaagctcatgaagagggtatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatcccacaaccagacctttctcattgatggccctgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagttaaaaactgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggacggatgctggtatgggatggaaatcagaccattaaaagagaaagaagagaatttggtcaactccctggtcacagccggacatgggcagattgacaacttttcactaggagtcttgggaatggcactattcctggaagaaatgctcaggacacgagtaggaacgaaacatgcaatactgctagttgcagtttcttttgtgacattgattactgggaacatgtcctttagagatttgggaagagtgatggttatggtgggcgctgccatgacggatgacataggtataggagtgacttatcttgccctactggcagctttcaaagtaagaccaacttttgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgaccatcatggccatctcgtgtgtcccaaatgcagtgatactgcaaaacgcatggaaggtgagctgcacaatattggcaacggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccactagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcattggaacctgggaaaaatccaagagctgtccaaacgaaacctggacttttcaaaaccaacaccggaaccataggcgccgtatctttggacttttcccctggaacgtcaggatctccaattgtcgataaaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagttgagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggattttgtggtcacaaccgacatttcagaaatgggtgccaacttcaaggctgagagggttatagaccccagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactatgcagacagaaggtggtgttttgatggagtcaagaacaaccaaatactagaagaaaacgtggaagtggaaatttggacaaaagaaggggaaaggaagaaattaaaacccagatggttggatgctagaatctattctgacccactggcactaaaagaattcaaggaatttgcggctggaagaaagtccttgaccctgaacctaatcacagaaatgggtagacttccaactttcatgacccagaaggcaagagacgcactagacaacctagctgtgctgcatacggctgaggcaggtggaagggcgtacaatcatgctctcagtgaactgccggagacccttgagacactacttttactgacactcctggctacagtcacgggaggaattttcttattcttaatgagtggaaaaggtgtagggaagatgaccctgggaatgtgctgcataataacggctagcatcctcctatggcatgcacagatacaaccacactggatagcagcttcaataatattggagttttttctcatagttttgctcattccagagccagaaaaacagagaacaccccaagataaccaactgacctacgttgtcatagccatcctcacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggacttcaagcgaaagcaactagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtattaatgatgaggactacatgggctttgtgtgaggctctaaccttagcgaccgggcccatctccacattgtgggaaggtaatccagggaggttttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaaccagtccccatgtcaacatatgggtggaatctagtacgcctgcagagtggagttgacgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacattgcaaaggaaatatggaggagccttagtgaggaatccactctcacgaaactccacacatgagatgtactgggtatccaatgctactgggaacatagtgtcgtcagtgaacatgatctcaaggatgctgattaacagattcacaatgaaacacaagaaagccacctacgagccagatgttgacctagggagcggaacccgcaacattggaattgagagtgagataccaaatctagacataataggaaagagaatagagaaaataaaacaagagcatgaaacatcatggcactatgaccaggaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgtgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagctttgggggccatattcactgatgagaacaaatggaagtcggcacgcgaggctgttgaagatagtaggttttgggagctggttgacaaggaaagaaatctccatcttgaagggaagtgtgaaacatgtgtgtacaacatgatgggaaagagagaaaagaaactaggggagttcggcaaggcaaaaggtagcagagccatatggtacatgtggcttggagcacgcttcttggagtttgaagccttgggattcttgaatgaggatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacctaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggcacctatggccttaacactttcaccaatatggaagcccaactaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccatttccatgagttaatcatgaaagacggtcgcgtgctcgtagttccatgcagaaaccaagatgaactgatcggcagggcccgaatttcccagggagctgggtggtctctgaaggagacggcctgtttggggaagtcttacgctcaaatgtggagtctgatgtacttccacagacgtgacctcaggctggcggcaaacgccatttgctcggcagtcccgtcacattgggttccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6959 - RNA, 9876 nt, synthetic construct
  misc_feature 1..9876: note = derived and/or modified CDS sequence (wt) from DENV-2__EU482779__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacattggattttgaactgataaaaacagaagccaaacaacctgccactctaaggaagtactgtatagaggcaaagctgaccaatacaacaacagaatctcgttgcccgacacagggggaacccagtttaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacaccccactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtcctcaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacactgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggctggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggagattttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgcttgtagttccatgcagaaaccaagatgaactgattggcagggcccgaatttcccagggagctgggtggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6960 - RNA, 9876 nt, synthetic construct
  misc_feature 1..9876: note = derived and/or modified CDS sequence (wt) from DENV-2__EU482780__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgtaaaaagaacatggaaggaaaaatcgtgcaaccagaaaatttggaatacaccatcgtgataacaccccactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggctggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgacccaagtactaatgatgaggactacatgggctttgtgtgaggctctaaccttagcgaccgggcccatctccacattgtgggaaggtaatccagggagattttggaacactactattgcagtgtcaatggccaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcatgctcgtagttccatgcagaaaccaagatgaactgattggcagggcccgaatttcccagggagctggatggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6961 - RNA, 9876 nt, synthetic construct
  misc_feature 1..9876: note = derived and/or modified CDS sequence (wt) from DENV-2__EU482781__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgtaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcagccaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggctggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgacccaagtactaatgatgaggactacatgggctttgtgtgaggctctaaccttagcgaccgggcccatctccacattgtgggaaggtaatccagggagattttggaacactactattgcagtgtcaatggccaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttggaagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctggatggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6962 - RNA, 9876 nt, synthetic construct
  misc_feature 1..9876: note = derived and/or modified CDS sequence (wt) from DENV-2__EU482782__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggatggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgtagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaatatccagcacttgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6963 - RNA, 9876 nt, synthetic construct
  misc_feature 1..9876: note = derived and/or modified CDS sequence (wt) from DENV-2__EU482783__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacgggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacggaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgactattatgacaggaggcattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagatcgacaacttttcactaggagtcttgggaatggcattattcctggaagaaatgctcaggacacgagtaggaacgaaacatgcaatactactagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcgctcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtagctggagggctccttactgtgtgttacgtgcttactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctacagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggctcccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagccgctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgatatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaaccatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggagattttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcgggacccgcaacattggaattgaaagtgagataccaaatctagacataataggaaagagaatagagaaaataaaacaagagcatgaaacatcatggcactatgaccaagaccacccatacaaaacatgggcttatcatggcagctatgaaacaaaacagactggatcggcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6964 - RNA, 9876 nt, synthetic construct
  misc_feature 1..9876: note = derived and/or modified CDS sequence (wt) from DENV-2__EU482784__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgctgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgtattttgtgactcaaaactcatgtcagcagccataaaagacagcagagccgtccacgccgatatgggttactggatagaaagcgcactcaatgacacatggaagattgagaaagcctcttttattgaagttaagagctgccactggccaaagtcacacactctctggagtaatggagtgctagaaagtgagatgataattccaaagaattttgcaggaccagtgtcacaacacaattacagaccaggctatcatacacaaacggcaggaccctggcatttaggcaggcttgagatggacttcgatttctgcgaaggaaccacagtggtggtgactgaggactgtggaaatagaggaccctctttaagaacaactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgataacttttcactaggagtcttgggaatggcactgttcctggaagagatgctcaggacccgaataggaacgaaacatgcaatattattagttgcagtttctttcgtgacattgatcacagggaacatgtcctttcgagatttggggagagtgatggtcatggtgggcgctactatgacggatgacataggcatgggcgtgacttatctcgccctattagcagccttcaaagttagaccaacttttgcagctggactactcttaagaaagctgacctccaaggaattgatgatgactaccataggaattgtactcctctcccaaagtactataccagagaccgttcttgaattgactgatgcgttagccttaggcatgatggttcttaaaatagtgagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggatacccttagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaggatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtagccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactaagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaataccttcaccaacatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6965 - RNA, 9876 nt, synthetic construct
  misc_feature 1..9876: note = derived and/or modified CDS sequence (wt) from DENV-2__EU482785__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgtaaaaagaacatggaaggaaaaatcgtgcaaccagaaaatttggaatacactatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacatcaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactggaaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtggaaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaacgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggctggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgacccaagtactaatgatgaggactacatgggctttgtgtgaggctctaaccttagcgaccgggcccatctccacattgtgggaaggtaatccagggagattttggaacactactattgcagtgtcaatggccaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctggatggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6966 - RNA, 9876 nt, synthetic construct
  misc_feature 1..9876: note = derived and/or modified CDS sequence (wt) from DENV-2__EU482786__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacaggaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccagccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaagaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgaggaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatggagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggcctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcaaagtggctgtggaaagaactagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtattttcacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6967 - RNA, 9876 nt, synthetic construct
  misc_feature 1..9876: note = derived and/or modified CDS sequence (wt) from DENV-2__EU482787__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcctgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgtaaaaagaacatggaaggaaaaatcgtgcaaccagaaaatttggaatacaccatcgtgataacacctcactcaggagaggagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatacttatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccagcaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacattcactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagccaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggctggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggagattttggaacactactattgcagtgtcaatggccaacatttttagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaaggaaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacaaactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctggatggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtagagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6968 - RNA, 9876 nt, synthetic construct
  misc_feature 1..9876: note = derived and/or modified CDS sequence (wt) from DENV-2__EU482788__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacgggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcattgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgactattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcggctggactactactgagaaagctgacctccaaggaattaatgatggctaccataggaatcgcgctcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtagctggagggctccttactgtgtgttacgtgctcactggacgatcggccgatttggaactggagagagccaccgatgtcaaatgggaagaccaggcagaaatatcaggaagcagcccaatcctgtcaataacgatagcagaagatggcagcatgtcgataaaaaatgaagaggaagaacaaacattgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggctcccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagccgctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgatatagcagcttgtctcaggaaaaatggaaagaaagtgatacaactcagtaggaagacctttgactccgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaacttttatgacccagaaggcaagaaacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggagattttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcgggacccgcaacattggaattgaaagtgaaataccaaatctagacataataggaaagagaatagagaaaataaaacaagagcatgaaacatcatggcactatgaccaagaccacccatacaaaacatgggcttatcatggcagctatgaaacaaaacagactggatcggcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaaggaatctccatcttgaagggaagtgtgaaacttgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgcgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 6969 - RNA, 9876 nt, synthetic construct
  misc_feature 1..9876: note = derived and/or modified CDS sequence (wt) from DENV-2__EU482697__SS-prME
  source 1..9876: mol_type = other RNA
tctgcaggcatgatcattatgttgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcactgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtatcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataatcaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagttggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacagagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactaaccatcatggacctccacccaggagcaggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagagatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcattaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcggaaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaactgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccatggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatttccatcttgaaggaaagtgtgagacatgtgtgtacaacatgatgggaaaaagagagaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagagatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgagagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagactacatgccatccatgaaaagattcagaagagaagaggaagaagcaggagtcctgtggtaa

SEQ ID NO: 6970 - RNA, 9876 nt, synthetic construct
  misc_feature 1..9876: note = derived and/or modified CDS sequence (wt) from DENV-2__EU482699__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaacttggaatacaccattgtggtaacaccccactcaggggaggagcatgcggtcggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattgccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacgtggataggaatgaactcacgcagcacctcactatctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcacaaccaaacctttctcattgatggccccgagacggcagagtgccccaacacaaatagagcttggaactcgttggaggttgaagactacggctttggagtgttcaccaccaatatatggctaagattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccttctttgagaacaactactgcctctggaaaactcataacagaatggtgctgtcgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggaatcttgggaatggcattgttcctggaggaaatgcttaggacccgagtaggaacgaaacatgcaatactactagctgcagtttcttttgtgacattgatcacagggaacatgtccttcaaagacctaggaagagtgatggttatggtaggcgctacaatggcggatgacataggtatgggcgtgacttatcttgccctactagcagccttcaaagttagaccaacttttgcagctgggctactcttgagaaggctgacctccaaggaattgatgatgactaccataggaattgtactcctctcccaaagtactataccagagaccgttcttgaattgactgatgcgttagccttaggcatgatggtccttaaaatagtaagaaaaatggaaaagtatcaattagcagtgactatcatggctatcttgtgtgtcccaaacgcagtgatactacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccgtgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccagaccccagccattagagctgagcacactgggcgggaaattgtggatctaatgtgtcatgccacatttacaatgaggctgctatcaccagttagagtgccaaattataacttgattatcatggatgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagcaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacccatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaatcaagaacaaccaaatcctggaagaaaatgtggaagttgaaatctggacaaaaggaggggaaaagaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagtattgagaattcctcagtgaatgtatccctaacagctatagccaaccaagcaacagtgttaatgggtctagggaaaggatggccattatcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggtatcatgaaaaacccaaccgtcgatggaataacagtgattgatctagatccaataccttatgacccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactgaaaaacgtaagagaagtgaaaggcctaacaaaaggaggaccaggacacgaagaacccatccccatgtcaacgtatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagtcctcaacccatatatgccctcagttatagaaaaaatggaagcactgcaaaggaaatatggaggagccttagtaagaaatccactctcacggaactccacacatgagatgtactgggtatccaatgcttctgggaacatagtgtcatcagtgaacatgatttcaaggatgttgatcaatagattcacaatgagacacaagaaagccacttacgagccagatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacggacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctgaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtagtgcgtgtgcaaagaccaacaccaagaggaacagtaatggacatcatatcgagaagagaccaaagaggtagtgggcaagttggtacctatggactcaacactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6971 - RNA, 9876 nt, synthetic construct
  misc_feature 1..9876: note = derived and/or modified CDS sequence (wt) from DENV-2__EU482701__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaagcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagaacaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgctgcagatggaaaataaagcttggctagtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatgcagcactcacaggagccacagaaatccaaatgtcgtcaggaaacttactcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggtttaagaaaggaagttctatcggccaaatgtttgagacaacgatgagaggggcgaagagaatggccattttgggtgacacagcctgggactttggatccctaggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcacaaccaaacctttctcattgatggccccgagacggcagagtgccccaacacaaatagagcttggaactcgttggaggttgaagactacggctttggagtgttcaccaccaatatatggctaagattgaaagaaaaacaggatgcattctgcgactcaaaactcatgtcggcggccgtaaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatggtaatcccaaagaatctcgctggaccagtgtctcaacacaactatagaccaggttaccatacacaaatagcaggaccatggcacctaggtaagcttgagatggactttgatttctgcgatggaaccacagtgatagtgactgaggactgcggaaatagaggaccttctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggaatcttgggaatggcattgttcctggaggaaatgctcaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctattagcagccttcaaagttagaccaacttttgcagctgggctactcttgagaaagctgacctccaaggaattgatgatgactaccataggagttgtactcctctcccaaagtactataccagacaccgttcttgaattgactgatgcgttagccttaggcatgatggtccttaaaatagtaagaaacatggaaaagtatcaattagcagtgactatcatggctatcttgtgtgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactctttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtgtctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaagcggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttacaatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagcaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacacattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcctacaaagtggcagctgaaggcatcaactatgcagacagaaggtggtgttttgatggaattaagaacaaccaaatcctggaagaaaatgtggaagtcgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgacccagaagacaagagacgcactggacaacctagcagtgctgcacacggctgaagcaggtggaagggcgtacaatcatgctctcagtgaactgccggagaccctagagacactgcttttactgacacttctggctacagtcacaggaggaatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagtattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaggcaaccagagaagcccagaaaagagcagcggcgggtatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagggtccttaatttagtagaaaactggttgaacaacaacactcaattttgcataaaagttctcaacccatatatgccctcagttatagaaaaaatggaagcactgcaaaggaaatatggaggagccttagtgaggaatccactctcacggaactccacacatgagatgtactgggtatccaatgcttctgggaacatagtgtcatcagtgaacatgatctcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtaacacagatggcaatgacagacacaactccatttggacaacagcgtgtttttaaagaaaaagtggacacgagaacccaagaaccgaaagaaggcacgaagaaattaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatctcgaaggaaagtgtgagacatgtgtgtacaacatgatggggaaaagagaaaagaagctaggggaattcggcaaggcaaaaggcagcagagccatatggtacatgtggcttggagctcgcttcctggagtttgaagccctaggattcctgaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaacactttcaccaatatggaagcccaattaatcagacagatggagggagaaggagtgtttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaagggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtattttcacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagagtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcttgtggtaa

SEQ ID NO: 6972 - RNA, 9876 nt, synthetic construct
  misc_feature 1..9876: note = derived and/or modified CDS sequence (wt) from DENV-2__EU482703__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagatacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattgtttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcacttttaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggattcgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctgggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtgctcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgggttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatatcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaagaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaggtggatgccattgatggcgaataccgtttgagaggagaagcaaggaaaacatttgtggacttaatgagaagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgctaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactacaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaaaccttgggacgtcctccccacggtgacacagatggcaatgacagatacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaaaaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggtagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatgaaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6973 - RNA, 9876 nt, synthetic construct
  misc_feature 1..9876: note = derived and/or modified CDS sequence (wt) from DENV-2__EU482705__SS-prME
  source 1..9876: mol_type = other RNA
tcggcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgcaccactacgggagaacatagaagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggcttcccggagcggataaacaagagtcaaattggatacagaaagaaacattggtcactttcaaaaatccccatgcgaagaaacaggatgttgttgttttaggatcccaagaaggggccatgcacacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaatatagaagcagaacctccattcggagacagctacatcatcataggagtagagccgggacaactgaaactcaattggttcaagaaaggaagttctattggccaaatgtttgagacaacgatgagaggggcgaagagaatggccattttgggtgacacagcctgggactttggatccctgggaggagtgtttacatctataggaaaagctcttcaccaagtctttggagcaatctatggagctgccttcagtggggtttcatggaccatgaaaatcctcataggagtcattatcacatggataggaatgaactcacgcagcacctcactgtccgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacacgggcaggttgacaatttttcactgggggtcttgggaatggcattgttcctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggataacataggtatgggcgtgacttatcttgccctactagcagccttcaaagttagaccaacttttgcagctgggctactcttgagaaggctgacctccaaggaattgatgatgactaccataggaattgtactcctctcccaaagtaccataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtatccgtttccccactgcttttgacatcctcacagcaaaaaacggattggataccattagcattgacaatcaagggtctcaatccaacagccatttttctaacaaccctctcaagaaccaacaagaaaagaagctggccactaaacgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaaacaaaaagggattcttggatattctcagatcggagctggagtttacaaagaaggaacatttcatacaatgtggcatgtcacacgtggcgctgtcctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgatattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggatgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacacgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatttttttattcctgatgagcgggaggggcatagggaagatgaccctgggaatgtgctgcataatcacggccagcatccttctatggtacgcacaaatacagccacactggatagcagcttcaataatactggagttttttctcatagttttgctcattccagaaccagaaaaacagagaacaccccaagacaaccaattgacctacgttgtcatagccatcctcacagtggtggctgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtttagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtactgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcagttttgcataaaagttctcaacccatatatgccctcagttatagaaaaaatggaagcactgcaaaggaaatatggaggagccttagtgagaaatccactctcacggaactccacacatgagatgtactgggtatccaatgcctctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagttatgaaacaaaacagactggatcagcatcatccatggtcaacggagtggtcaggctgctgacaaagccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctagagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagagattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcgataaatcaggttagatctcttataggcaatgaggaatacacagattacatgccatccatgaaaagattcagaagagaagaggaagaagcaggagtcctgtggtaa

SEQ ID NO: 6974 - RNA, 9876 nt, synthetic construct
  misc_feature 1..9876: note = derived and/or modified CDS sequence (wt) from DENV-2__EU482463__SS-prME
  source 1..9876: mol_type = other RNA
tctgcaggcatgatcattatgctgattccaacagtgatggcgtttcatctaaccacacgcaacggagaaccacacatgatcgtcagtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacacagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaattctggcatacaccatagggacgacacatttccagagagtcctgattttcattctactgacagccgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacagaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcaccttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccttgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgtgactcaaaactcatgtcggcggccataaaagacaacagagccgtccatgccgacatgggttactggatagaaagtgcactcaatgacacatggaagatagagaaagcctctttcattgaagtgaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggaatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgttacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggcgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcttgagaaaaaatggaaagaaagtaatacaacttagtaggaagacttttgattcagagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgactctgaacctaatcacagaaatgggtaggcttccaacattcatgactcagaagacaagagacgcactggacaacctagcagtgctgcacacggctgaagcaggtggaagggcgtacaatcacgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactagagttttttctcatagttttacttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccttaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcataggaccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcctatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccttcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaaaaccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgctttctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaataaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccgtggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6975 - RNA, 9876 nt, synthetic construct
  misc_feature 1..9876: note = derived and/or modified CDS sequence (wt) from DENV-2__EU482464__SS-prME
  source 1..9876: mol_type = other RNA
tcggcaggcatgatcattatgctgattccaacagtgatggcgttccatctaaccacacgcaacggagaaccacacatgattgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtctacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaacttggaatacaccattgtggtaacacctcactcaggggaggagcatgcggtcggaaatgacacaggaaaacacggcaaggaaatcaaagtaacgccacagagttccatcacagaagcagaattgacaggttatggcaccgtcacgatggagtgttccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatctatggagctgccttcagtggggtttcatggaccatgaaaatcctcataggagtcataatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaattatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgtgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacacgagtaggaacgaaacatgcaatactactagttgcagtttcttttgtgacattgatcacagggaacatgtccttcaaagacctaggaagagtggtggttatggtaggcactacaatggcggatgacataggtatgggcgtgacttatcttgccctactagcagccttcaaagttagaccaacttttgcagctgggctactcttgagaaagctgacctccaaggaattgatgatgactaccataggaatcgtactcctctcccaaagtaccataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttttaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatacgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagtcagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggagaacctctggaaaatgatgaagattgtgcacactggaaagaagccaaaatgctcctagataacattaacacaccagaaggaatcattcctagtatgtttgaaccagagcgtgaaaaagtggatgccattgatggcgaataccgcttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaattctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtaatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagtcccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtactgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggtaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagagaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaagatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaataccttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttggcagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6976 - RNA, 9876 nt, synthetic construct
  misc_feature 1..9876: note = derived and/or modified CDS sequence (wt) from DENV-2__EU482465__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaataaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcatctgcaaacactccatggtagacagaggatggggaaatggatgtggactatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacactggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaacggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggagggggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctagacttttcccctggaacgtcaggatctccaatcatcgacaaaaaaggaaaagttgtgggtctttatggtaatggtgttgtcacaaggagtggagcatatgtgagtgctatagcccaaactgaaaaaagcactgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccattccctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaggtggatgccattgatggcgaataccgtttgagaggagaagcaaggaaaacatttgtggacttgatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataaccacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagttctcaacccatacatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgctcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6977 - RNA, 9876 nt, synthetic construct
  misc_feature 1..9876: note = derived and/or modified CDS sequence (wt) from DENV-2__EU482466__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgtaccctcatggctatggatcttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactatcatgacaggagacatcaaaggaatcatgcaggcaggaaaacgatccttgcggcctcagcccactgagctgaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtctgcggccataaaagacaacagagccgtccatgccgacatgggttactggatagaaagtgcactcaatgacacatggaagatagagaaagcctctttcattgaggtaaaaaactgccactggccgaaatcacacaccctctggagtaatggagtgctagaaagtgagatgataatcccaaagaatctcgctggaccagtgtctcaacacaattatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacgttgatcacagggaacatgtccttcaaagacctaggaagagtggtggttatggtaggcgccacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattaactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccctacccatgggaaaggctgaactggaagatggagcctacagaatcaagcaaaaagggattcttgggtattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacatcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaattataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatctcagaaatgggtgccaatttcaaagctgagagggttatagaccccagacgctgcatgaagccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggccacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattagtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggaccacatgggctctgtgtgaggccttgaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgtttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacccttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacggtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6978 - RNA, 9876 nt, synthetic construct
  misc_feature 1..9876: note = derived and/or modified CDS sequence (wt) from DENV-2__EU482467__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatataccattgtggtaacacctcactcaggggaggagcatgcggtcggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgcttttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtaggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggacttttccccatatcaataccaatcacggcagcagcatggtacctgtgggaagtgaagaaacaacgggccggagtattgtgggacgttccttcacctccacccatgggaaaggctgaactggaagatggagcctacagaatcaagcaaaaagggattcttggatattctcagatcggagctggagtttacaaagaaggaacttttcatacaatgtggcatgtcacacgtggtgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatatcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaatcaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagataaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcatcgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcataggaccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacaccaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccctagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggacgttgacctcggaagcggaacccgaaacattggaattgaaagtgaaataccaaacttagacataattgggaaaagaatagaaaaaataaagcaagagcatgaaacatcatggcactacgaccaagaccatccatacaaaacatgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggcaatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaggaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccaccacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagatcagaaaagatatacaacagtgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccgtacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6979 - RNA, 9876 nt, synthetic construct
  misc_feature 1..9876: note = derived and/or modified CDS sequence (wt) from DENV-2__EU482468__SS-prME
  source 1..9876: mol_type = other RNA
tctgcaggtatgatcattatgctgattccaacagtgatggcgttccatctaaccacacgcaacggagaaccacacatgatcgtcggtatacaggagaaagggaaaagtctactgttcaaaacagaggatggtgtgaacatgtgcaccctcatggccatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcatgagacatccaggcttcaccataatggcagcgatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacctagcctaaaagaagagcaggacaagaggttcgtctgcaaacactccatggtagacagaggatggggaaatggatgtggattatttggaaagggaggcattgtgacctgtgctatgttcacatgcaaaaagaacatggaagggaaaatcgtgcagccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggtaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacggtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcctactgagctgaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatggaaagtgcactcaatgacacatggaagatagagaaagcctctttcattgaagtaaaaaactgccattggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccttctttgagaacaactactgcctctggcaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagccggactactcttgagaaagctgacctccaaggaattaatgatgactaccataggaattgtactcctttcccaaagtactataccagagaccgttcttgaattgactgatgcgttagccctaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggatacccttagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggatgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattgatcttggcccccactagagttgtggcagctgaaatggaggaagctctcagaggacttccaataagataccaaaccccagccatcagagctgagcacactgggcgggaaattgtggacctaatgtgtcatgccacatttaccatgaggctgctatcaccagttagagtgccaaactataacttgattatcatggacgaagcccatttcacagacccagcaagtatagcggctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgctttgatggaataaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctttgaccctgaacctaatcacagaaatgggtaggcttccaacattcatgactcagaagacaagagacgcactggataacctagcagtgctgcacacagctgaagcaggtggaagggcgtacaatcatgctctcagtgaactgccggagaccctagagacactgcttttactgacacttctggctacagttacaggagggatctttttattcttgatgagcgggaggggcatagggaagatgaccctgggaatgtgctgcataatcacggctagcacccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatctctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggccctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggacgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtccttcccacggtgacacagatggcaatgacagacacgactccgtttggacaacagcgtgtttttaaagaaaaagtggacacgagaacccaggaaccgaaagaaggcacgaagaaactaatgaaaatcacagcagagtggctgtggaaagaactagggaagaaaaagactcctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaagaaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctacacaagctaggttacattctaagagacgtgagcaaaaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaataaggtggtgcgtgtgcaaagaccaacaccaagaggcacagtaatggacatcatatcgagaagagaccaaagaggtagtgggcaagttggtacctatggactcaataccttcaccaatatggaagcccaattaatcagacagatggagggagaaggagtctttaaaaacatccagcacctgacagtcacagaagaagttgccgtgcataactggttggcaagagtggggcgcgaaaggttatcaagaatggccatcagtggagatgattgtgttgtgaaacctttagatgacaggttcgcaaacgctttgacagccctaaatgacatgggaaagattaggaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtaccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6980 - RNA, 9876 nt, synthetic construct
  misc_feature 1..9876: note = derived and/or modified CDS sequence (wt) from DENV-2__EU482469__SS-prME
  source 1..9876: mol_type = other RNA
tctgcaggcatgatcattatgctgattccaacagtaatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacctggatcctgagacatccaggcttcaccataatggcagcaatcctggcacacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagagattcgtctgcaaacactccatggtagacagaggatggggaaatggatgtggattatttggaaagggaggcatcgtgacctgtgctatgttcacatgcaaaaagaacatggaagggaaaatcgtgcaaccagagaacttggaatacaccattgtggtaacacctcactcaggggaggagcatgcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcatcaggaaacttgctcttcactggacatctcaagtgcaggctgagaatggacaagctacagcttaaaggaatgtcatactccatgtgcacaggaaagtttaaagtcgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccatcttgggtgacacagcctgggacttcggatccctgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattaaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaacctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggtcatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaactaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggactgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaaacattgaagacaaccccgagatcgaagatgacattttccgaaagagaagactgaccatcatggacctccacccaggagcgggaaagacgaaaagataccttccagccatagtcagagaagccataaaacggggtctgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccttagagacactgcttttattgacacttctggccacagtcacaggagggatctttttattcttgatgagcgggaggggcatagggaagatgaccctggggatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggccacaacattcgttacaccaatgctgagacacagcattgagaattcctcagtgaatgtatccctaacagctatagccaaccaagcaacagtgttaatgggtctagggaaaggatggccattgtcaaagatggacatcggagttcctcttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacacaggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatacgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaaaaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtacgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacattcaagcagcaataaatcaggttagatctcttataggcaatgaggaatacacagattacatgccatccatgaaaagattcagaagagaagaggaagaagcaggagtcctgtggtaa

SEQ ID NO: 6981 - RNA, 9876 nt, synthetic construct
  misc_feature 1..9876: note = derived and/or modified CDS sequence (wt) from DENV-2__EU482470__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacatacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagcccaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcgaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaactacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttctcactgggagtcttgggaatggcattgttcctggaagaaatgcttaggacccgagtaggaacgaaacatgcaatactactagttgcagtttcttttgtgacattgatcacagggaacatgtccttcaaagacctaggaagagtggtggttatggtaggcgccacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatgactatcttgtgcgtcccaaacgcagtgatattacaaaatgcatggaaagtgagttgcacaatactggcagtggtgtccgtttccccactgcttttgacatcctcacggcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgacattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaggaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggtcacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataatattaacacaccagaaggaattattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaattatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacgccccaagacaaccaattgacctacgttgtcatagccatcctcacagtggtggccgcaaccatggcaaacgagatgggtttcctagaaaaaacgaagaaggatcttggattgggaagcattgcaacccagcaacccgagagcaacatcctggacatagacctacgccctgcatcagcttggacgttgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatcttcagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaacctggtgcgtcttcagagtggagttgacgtcttcttcatcccgccagaaaagtgtgacacattgttgtgtgacataggggagtcatcgccaaatcccacagtggaagcaggacgaacactcagagtccttaatctagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtgggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacttatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacattcaagcagcaataaatcaggttagatctcttataggcaatgaggaatacacagattacatgccatccatgaaaagattcagaagagaagaggaagaagcaggagtcctgtggtaa

SEQ ID NO: 6982 - RNA, 9876 nt, synthetic construct
  misc_feature 1..9876: note = derived and/or modified CDS sequence (wt) from DENV-2__EU482471__SS-prME
  source 1..9876: mol_type = other RNA
tctgcaggcatgatcattatgctgattccaacagtaatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagacttcgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggagaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcattcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagttatcatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattaaatcacattctagcagaaaatgaggtgaagttgactattatgacaggagacatcagaggaatcatgcaggcaggaaaacgatccttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcgggaccatggcacctaggtaagcttgagatggactttgatttctgcgatggaaccacagtgatagtgactgaggactgcggaaacagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggtcatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgctagccttaggtatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccaatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgttggcactggagcctggaaaaaatccaagagccgtccaaacgaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagctatagtcagagaagccataaaacggggtctgagaacattaatcttggcccccactagagttgtggcagctgaaatggaggaagctcttagaggacttccaataagataccaaaccccagccatcagagctgagcacactgggcgggaaattgtggatctaatgtgtcatgccacatttaccatgaggctgctatcaccagttagagtgccaaactataacttgatcatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactagcgctaaaagagttcaaagaatttgcagccggaagaaagtctctgaccctgaacctaatcacagaaatgggtaggcttccaacattcatgactcagaagacaagagacgcactggataacctagcagtgctgcacacggctgaagcaggtggaagggcgtacaatcatgctctcagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcaggggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtatcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacattagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcctgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6983 - RNA, 9876 nt, synthetic construct
  misc_feature 1..9876: note = derived and/or modified CDS sequence (wt) from DENV-2__EU482472__SS-prME
  source 1..9876: mol_type = other RNA
tctgcaggcatgatcattatgctgattccaacagtgatggcgttccatctaaccacacgcaacggagaaccacacatgatcgtcggcatacaggagaaagggaaaagtcttctgttcaaaacagaggatggtgtgaacatgtgcaccctcatggccatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcagccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggtaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtcttcggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatggaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccttctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctttcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggatacccttagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaataataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgctttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctttgaccctgaacctaatcacagaaatgggtaggcttccaacattcatgactcagaagacaagagacgcactggataacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactcttacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccggttgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaataccttcaccaatatggaagcccaattaatcagacagatggagggagaaggagtctttaaaaacatccagcacctgacagtcacagaagaagttgccgtgcataactggttggcaagagtggggcgcgaaaggttatcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6984 - RNA, 9876 nt, synthetic construct
  misc_feature 1..9876: note = derived and/or modified CDS sequence (wt) from DENV-2__EU482473__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttttgttcaaaacagaggatggtgtgaacatgtgcaccctcatggctatggaccttggtgaattgtgtgaagacacgatcacgtacaagtgtcctcttctcaggcagaatgagccagaagacatagactgctggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggtttaagaaaggaagttctatcggccaaatgtttgagacaacgatgagaggggcgaagagaatggccattttgggtgacacagcctgggactttggatccctaggaggagtgtttacatctataggaaaagccctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggggacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcttacagaatcaagcaaaaagggattcttggatattctcagatcggagctggagtttacaaagaaggaacttttcatacaatgtggcacgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaaccaacaccggaacaataggtgctgtatctctggacttttcccctggaacgtcaggatctccaatcatcgacagaaaaggaaaagttgtgggtctttatggtaatggtgttgtcacaaggagtggagcatatgtgagtgccatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccattagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcctccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtctgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcaggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccctagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggccttacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaacaccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaagagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcctttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagtagcaataaatcaggttagatctcttataggcaatgaggaatacacagattacatgccatccatgaaaagattcagaagagaagaggaagaagcaggagtcctgtggtaa

SEQ ID NO: 6985 - RNA, 9876 nt, synthetic construct
  misc_feature 1..9876: note = derived and/or modified CDS sequence (wt) from DENV-2__EU482474__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagggaaaaaagatcagtggcactcgtcccacatgtgggaatgggactggagacgcgaaccgaaacatggatgtcatcagaaggggcttggaaacatgcccagagaatagaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggtcgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccggtgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtgacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggacttggaaaaaagatatgtcttaggccgcctgatcacagtcaacccaattgtaacagaaaaagatagcccaatcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaattcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtctcacaaccaaacctttctcattgatggccccgagacggcagagtgccccaacacaaatagagcttggaactcgttggaggttgaagactacggctttggagtgtttaccaccaatatatggctaagattgaaagaaaaacaggatgcattctgcgactcaaaacttatgtcggcggccataaaagacaacagagccgtccatgctgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctatcatacacaaatagcaggaccatggcacctaggtaagcttgagatggactttgatttctgcgatggaaccacagtgatagtgactgaggactgcggaaatagaggaccttctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttggggatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtgagaaacatggaaaagtatcaattagcagtgactatcatggctatcttgtgtgtcccaaacgcagtgatattacaaaatgcatggaaagtgagttgcacaatactggcagtggtgtctgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgcagttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagcggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagagggcttccaataagataccaaaccccagccatcagagctgagcacactggacgggaaattgtggatctaatgtgtcatgccacatttacaatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagtataaaagcaggaaatgatatagcagcttgcctgagaaaaaatggaaagaaagtaatacaacttagcaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgagaaaaagtggatgccgttgatggcgaataccgtttgagaggagaagcaaggaaaacctttgtggacttaatgaggagaggagacttaccagtctggctggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcatagtcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatctcggattaggaagcattgcaacccagcaacccgagagcaacatcctggacatagacctacgtcccgcatcagcttggacgctgtatgccgtggctacaacattcgttacaccaatgctgagacatagtattgagaattcctcagtgaatgtatccctaacagccatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaatatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggtagcagagccatatggtacatgtggcttggagctcgcttcctggagtttgaagccctaggattcctgaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaagctaacgtatcaaaacaaggtggtgcgtgtgcaaagaccaacaccaagaggaacagtaatggacatcatatcgagaagagaccaaagaggtagtgggcaagttggtacctatggactcaacactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaattgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccagtggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6986 - RNA, 9876 nt, synthetic construct
  misc_feature 1..9876: note = derived and/or modified CDS sequence (wt) from DENV-2__EU482475__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtattgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggaatgctccccgagaacaggcctcgacttcaatgagatggtgttgcttcagatggaaaataaagcttggctggtgcataggcaatggtttctagacctgccattaccatggctgcccggagcggacaaacaagagtcaaattggatacagaaagaaacattggtcacttttaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctcattcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctattatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcgataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggagggggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctttggacttttcccctggaacgtcaggatctccaatcatcgacaaaaaaggaaaagttgtgggtctctatggtaatggtgttgtcacaaggagtggagcatatgtgagtgctatagcccaaactgaaaaaagcattgaagataaccccgagatcgaagatgacattttccgaaagagaagactgaccatcatggacctccacccaggagcgggaaagacgaaaagataccttccagccatagtcagagaagccataaaacggggattgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaattattcctagtatgtttgaaccagagcgtgaaaaggtggatgccattgatggcgaataccgtttgagaggagaagcaaggaaaacatttgtggacttaatgaggagaggagacttaccagtctggttggcttacaaagtggcagctgaaggcatcaactatgtagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatacttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctggatccaataccttatgatccaaagtttgaaaagcagttgggacaagtaatgctactaatcctctgcgtgactcaagtattgatgatgaggaccacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagagaagtggaatccaggaagtggatagaaccttagcaaaagaaggcatcaaaagaggagagacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacatgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggacgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagcaggttttgggagctggttgacaaggaaaggaatctccatcttgaaggaaagtgtgagacatgtgtgtacaacatgatgggaaaaagagaaaagaagctaggggaattcggcaaggcaaaaggtagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatgaaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6987 - RNA, 9876 nt, synthetic construct
  misc_feature 1..9876: note = derived and/or modified CDS sequence (wt) from DENV-2__EU482541__SS-prME
  source 1..9876: mol_type = other RNA
tctgcaggcatgatcattatgctgattccaacagtaatggcgttccatctaaccacacgcaacggagaaccacacatgatcgtcggtatacaggagaaagggaaaagtcttctgttcaaaacagaggatggtgtgaatatgtgcaccctcatggctatggaccttggtgaattgtgtgaagacacaatcacgtacaagtgtcctcttctcaggcagaatgagccagaagatatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcactataatggcagcaatcctggcgtacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagagaacttggaatacaccattgtggtaacacctcactcaggggaggagcatgcggtcggaaatgacacaggaaaacacggcatggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggttactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatctggaaaaaagatatgtcttaggccgcctaatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccttgggaggagtgtttacatctataggaaaagctctccaccaagtctttggagcaatctatggagctgccttcagtggggtttcatggaccatgaaaatcctcataggagtcatcatcacatggataggaatgaactcacgcagcacctcactgtctgtgtcactagtactggtgggaattgtgacactgtatttgggagtcatggtgcaggccgatagtggttgcgtcgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattaaatcacattctagcagaaaatgaagtgaagttgactattatgacaggagacatcagaggaatcatgcaggcaggaaaacgatctttgcggcctcagcccgctgagctaaagtattcatggaaaacatggggtaaagcaaaaatgctctccacagaatcttataaccaaacctttctcattgatggccccgagacggcagagtgccccaacacaaatagagcttggaactcgttggaggttgaagactacggctttggagtgttcaccaccaacatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactacagaccaggctaccatacacaaatagcgggaccatggcacctaggtaagcttgagatggactttgatttctgtgatggaaccacagtgatagtgactgaggactgcggaaatagaggaccctctttgagaacaactactgcctctggaaaactcataacagaatggtgctgccgatcttgcacattaccacccctaagatatagaggtgaggatgggtgctggtacgggatggaaatcagaccgttgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctattagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacctggaactggagagagcaaccgatgtcaaatgggaagaccaggcagagatatcaggaagcagtccaatcctgtcaataacaatatcagaagatggtagtatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtctgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaggaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctcttagtgaactgccggagaccttagagacactgcttttactgacacttctggccacagtcacaggagggatctttttattcttgatgagcgggaggggcatagggaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcctataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaagaagtggataggaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctggaaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacgtcatggcactacgaccaagaccacccatacaaaacgtgggcataccacggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccaaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagatctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcgcctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccattttcatgagctaatcatgaaggatggtcgtatacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagatttagaagagaagaggaagaagcaggagtcctgtggtaa

SEQ ID NO: 6988 - RNA, 9876 nt, synthetic construct
  misc_feature 1..9876: note = derived and/or modified CDS sequence (wt) from DENV-2__EU482542__SS-prME
  source 1..9876: mol_type = other RNA
tctgcaggcatgatcattatgttgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttcttaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggattttgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattgtttggaaagggaggcattgtgacctgtgctatgttcacatgcaaaaagaacatggaagggaaaatcgtgcaaccagaaaatttggaatacaccattgtggtaacacctcactcaggggaggagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcaaatggaaaataaagcttggctggtgcataggcaatggtttctagacctgccattaccatggctgcccggagcggataaacaagagtcaaattggatacagaaagagacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagttcaaagttgtgaaggaaatagcagaaacacaacatggaacgatagtcatcagagtgcaatatgaaggggacggctctccatgtaaagtcccttttgagataatggatttggaaaaaagatacgtcttaggccgcctgatcacagtcaacccaattgtaacagaaaaagacagcccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgctttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacagtacaagttccaaccagaatccccttcaaaactagcttcagctatccagaaagctcaagaagagggaacttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctagttaactccttggtcacagccggacatgggcaggttgacaatttttcactgggagtcttgggaatggcattgttcctggaggaaatgcttaagacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagcctttaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctatcaataacaatatcagaagatggtagcatgtcgataaaaaacgaagaggaagaacaaacactgaccatactcattagaacaggattgctggtaatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcccggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtaagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagctactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgagaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaagggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacctggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtgagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagatataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacttaaaaaatgaagaaatggtaacaaaccacatggaaggagaacacaagaaattggccgaggccattttcaaactaacgtatcaaaacaaggtggtgcgtgtgcaaagaccaacgccaagaggaacagtaatggacatcatatcgagaagagaccaaagaggtagtgggcaagttggtacctatggactcaatacttttaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagacatacaacagtgggaaccttcaaaaggatggaacgattggacacaagtgcccttctgttcacaccatttccatgagctaatcatgaaggatggtcgtatacttgttgttccatgtagaaaccaagatgaactgattggcagagcccgaatctcccaaggagcagggtggtctttgcgggagacggcctgtttggggaagtcttacgctcaaatgtggagcttgatgtacttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaactccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaggcaggagtcctgtggtaa

SEQ ID NO: 6989 - RNA, 9876 nt, synthetic construct
  misc_feature 1..9876: note = derived and/or modified CDS sequence (wt) from DENV-2__JX966380__SS-prME
  source 1..9876: mol_type = other RNA
actgcaggcatgatcatcatgctgattccaacagtgatggcgtttcatctgaccacacgcaacggagaaccacacatgatcgtcagtagacaagaaaaagggaaaagccttctgtttaagacaaaggacggcacgaacatgtgtaccctcatggccatggaccttggtgagttgtgtgaagacacaatcacgtataaatgtccttttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattatttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatgaaagacaaagcttggctggtgcacagacaatggttcctagacctaccgttgccatggctgcccggagcagacacacaaggatcaaattggatacagaaagagacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatctcaagtgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggcgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcacatcactgtctgtgtcactggtattagtgggaatcgtgacactgtacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcttcagccatccagaaagctcatgaagagggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaacgctctccacagaactccacaatcagaccttcctcattgatggtcccgaaacagcagaatgccccaacacaaacagagcttggaattcactagaagttgaggactacggctttggagtattcactaccaatatatggctaagattgagagaaaagcaggatgtattttgtgactcaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggactacagtggtggtaaccgaggactgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgataatttctcattaggaatcttgggaatggcactgttccttgaagaaatgctcaggactcgagtaggaacgaaacatgcaatattactagtcgcagtttctttcgtaacgttaatcacagggaacatgtcttttagagacctgggaagagtgatggttatggtgggtgccaccatgacagatgacataggcatgggtgtgacttatcttgctctactagcagctttcaaagtcagaccaacctttacagctggactgctcttgagaaaactgacctccaaggaattaatgatgaccaccataggaatcgttcttctctcccagagtagcataccagagaccattcttgaactgaccgatgcgttagctttaggcatgatggtcctcaagatggtgagaaacatggaaaaatatcagctggcagtgactatcatggctattttgtgcgtcccaaatgctgtgatattacagaacgcatggaaagtgagttgcacaatattggcagtggtgtctgtttcccccctgctcttaacatcctcacaacagaaagcggactggataccattagcgttgacgatcaaaggcctcaatccaacagccatttttctaacaaccctctcaagaaccagcaagaaaaggagctggcctttaaatgaggccatcatggcggttgggatggtgagtatcttggccagctctctcttaaagaatgacatccccatgacaggaccattagtggctggagggcttcttactgtgtgctacgtactaactgggcggtcagccgatctggaactagagagagctaccgatgtcaaatgggatgaccaggcagagatatcaggtagcagtccaattctgtcaataacaatatcagaagatggcagcatgtcaataaagaatgaagaggaagagcaaacactgactatactcattagaacaggattgcttgtgatctcaggactctttccggtatcaataccaatcacagcagcagcatggtacctgtgggaagtaaagaaacaacgggctggagtgttgtgggatgtcccctcaccaccacccgtgggaaaggctgaattggaagatggagcctacagaatcaagcaaaaaggaatccttggatattcccagatcggagctggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggtgccgtatctctggacttttcccctgggacgtcaggatctccaatcgtcgacaaaaaaggaaaagttgtaggtctctatggcaatggtgtcgttacaaggagtggagcatatgtgagtgccatagctcagactgaaaaaagcattgaagacaatccagagattgaagatgacatctttcgaaagagaagattgaccatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagctatcagggctgagcacaccgggcgggagattgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggacgaagaaagagaaattccggaacgttcatggaactccgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatatgtcaagactagaaccaatgactgggatttcgtggttacaactgacatctcggaaatgggtgccaactttaaagctgagagggttatagaccccagacgctgcatgaaaccagttatactgacagacggcgaagagcgggtgattctggcaggacccatgccagtgacccactctagtgcagcacaaagaagagggagaataggaaggaatccaaggaatgaaaatgatcaatatatatatatgggggaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaacaatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtatgcacaaatacaaccacattggatagcagcttcaataatattggagttctttctcatagtcttgctcattccagaaccagaaaagcagaggacaccccaggataatcaattgacttatgtcatcatagccatcctcacagtggtggccgcaaccatggcaaacgaaatgggttttctggaaaaaacaaagaaagacctcggactgggaaacattgcaactcagcaacctgagagcaacattctggacatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcgggaaaggatggccattgtcaaagatggacattggagttcccctccttgctattgggtgttactcacaagtcaaccctataaccctcacagcggctcttcttttattggtagcacattatgccatcataggaccgggacttcaagccaaagcaaccagagaagctcagaaaagagcagcagcgggcatcatgaaaaacccaactgtggatggaataacagtgatagatctagatccaataccctatgatccaaagtttgaaaagcagttgggacaagtaatgctcctagtcctttgcgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatctttagagggagttacctggctggagctggacttctcttttctatcatgaagaacacaaccagcacgagaagaggaactggcaacataggagaaacgctaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggtagagggggctggtcatactattgtggaggattaaagaatgtaagagaagttaaaggcttaacaaaaggaggaccaggacacgaagaacctatccctatgtcaacatatgggtggaatctagtacgcttacagagcggagttgacgtcttttttgttccaccagagaagtgtgacacattgttgtgtgacataggggaatcatcaccaaatcccacggtagaagcgggacgaacactcagagtccttaacctagtggaaaattggctgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacagtaatggacatcatatcgagaagagaccaaaggggtagtggacaagttggcacctatggcctcaacactttcaccaacatggaagcacaactaattaggcaaatggagggggaaggaatcttcaaaaacatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtatggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtag

SEQ ID NO: 6990 - RNA, 9876 nt, synthetic construct
  misc_feature 1..9876: note = derived and/or modified CDS sequence (wt) from DENV-2__JX966379__SS-prME
  source 1..9876: mol_type = other RNA
actgcaggcatgatcatcatgctgattccaacagtgatggcgtttcatctgaccacacgcaacggagaaccacacatgatcgtcagtagacaagaaaaagggaaaagccttctgtttaagacaaaggatggcacgaacatgtgtactctcatggccatggaccttggtgagttgtgtgaagacacaatcacgtataaatgtccttttctcaagcagaacgaaccagaagacatagattgttggtgcaactccacgtccacatgggtaacttacggaacatgtaccaccacaggagagcacagaagaggaaaaagatcagtggcgcttgttccacacgtgggaatgggattggagacacgaactgaaacatggatgtcatcagaaggggcctggaaacatgcccagagaattgaaacttggattctgagacatccaggcttcactataatggccgcaatcctggcatacaccataggaacgacgcattttcaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgcctccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattgtttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatggaagacaaagcttggctggtgcacagacaatggttcctagacctaccgttgccatggctgcccggagcagacacacaaggatcaaattggatacagaaagagacattggtcaccttcaaaaatccccatgcgaaaaaacaggatgttgttgtcttaggatcccaagaaggggctatgcacacagcactcacaggggctacagaaatccagatgtcatcaggaaacctgctgttcacaggacatctcaaatgcaggctgagaatggataaattacaacttaaagggatgtcatactccatgtgcacaggaaagtttaaaattgtgaaggaaatagcagaaacacaacatggaacaatagtcattagagtacaatatgaaggagacggctctccttgcaagatcccctttgagataatggatctggaaaaaagacatgttttgggccgcctgatcacagtcaacccaattgtaacagaaaaggacagtccagtcaacatagaagcagaacctccatttggagacagctacatcatcataggagtggaaccaggacaattgaagctggactggttcaagaaaggaagttccattggccaaatgtttgagacaacaatgaggggagcgaaaagaatggccatcttgggcgacacagcctgggactttggatctctgggaggagtgttcacatcaataggaaaagctctccaccaggtttttggagcaatctacggggctgctttcagtggggtctcatggaccatgaagatccttataggagttatcattacatggataggaatgaactcacgtagcacatcactgtctgtgtcactggtattagtgggaatcgtgacactgtacttgggagttatggtgcaagctgatagtggttgcgttgtgagctggaagaacaaagaattaaaatgtggcagtggaatattcgtcacagataacgtgcatacatggacagaacaatacaagtttcaaccagaatccccttcaaaactggcctcagccatccagaaagctcacgaagaaggcatctgtggaatccgctcagtaacaagactggaaaatcttatgtggaaacagataacaccagaattgaatcatattctatcagaaaatgaagtgaaactgaccatcatgacaggagacatcaaaggaattatgcaggtaggaaaacgatctctgcggcctcaacccactgagttgaggtattcatggaaaacatggggtaaagcgaaaatgctctccacagaactccacaatcagaccttcctcattgatggtcccgaaacagcggaatgccccaacacaaacagagcttggaattcactagaagttgaggactatggctttggagtattcactaccaatatatggctaagattgagagaaaagcaggatgtattttgtgactcaaaactcatgtcagcggccataaaggacaacagggctgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaactacgctggaccagtgtcacaacataataacagaccaggctatcacacacaaacagcaggaccttggcatctaggcaagcttgagatggactttgatttctgcgaagggaccacagtggtggtaaccgaggaatgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgacaatttctcattaggaattttgggaatggcactgttccttgaagaaatgctcaggagtcgagtaggaacgaaacatgcaatactactagtcgcagtttctttcgtaacgttaatcacagggaacatgtcttttagagacctgggaagagtgatggttatggtgggtgccactatgacagatgacataggcatgggtgtaacttatcttgctctactagcagcctacaaagtcagaccaacctttgcagctggattgctcctgagaaaactgacctccaaggaactaatgatgaccaccataggaatcgttcttctctctcagagtagcataccagagaccattcttgagctgaccgatgcgttagctttaggcatgatggtcctcaagatggtgagaaacatggaaaaatatcagctggcagtgactatcatggctattttgtgtgtcccaaatgctgtgatattacagaacgcatggaaagtgagttgcacaacactggcagtggtgtctgtttcccccctgctcttgacatcctcacaacagaaagcggattggataccattagcgttgacgatcaaaggcctcaatccaacagccatttttctaacaaccctctcaagaactagcaagaaaaggagctggcctttaaacgaggccatcatggcggttgggatggtgagtatcttggccagctctctcttgaagaacgacatccccatgacaggaccattagtggctggagggcttcttactgtgtgctacgtattaactgggcggtcagccgacctggaactagagagagctaccgatgtcaaatgggatgaccaggcagagatatcaggtagcagtccaattctgtcgataacaatatcagaagatggcagcatgtcgataaagaatgaagaggaagagcaaacactgactatactcattagaacaggattgcttgtgatctcaggactctttccggtatcaacaccaattacagcggcagcatggtacctgtgggaagtaaagaaacagcgggctggagtgttgtgggatgttccctcaccaccacccgtgggaaaggccgaattggaagatggagcctacagaattaagcaaaaaggaatcctaggatattcccagatcggagctggagtttacaaagagggaacatttcacaccatgtggcacgtcacacgcggcgctgtcctaatgcataaagggaaaaggattgaaccgtcatgggcggacgtcaagaaagacttaatatcatatggaggaggttggaagctagaaggagaatggaaagaaggagaagaagtccaggtcttggcattggaacctggaaaaaatccaagagccgtccaaacaaaacctggcctttttagaaccaacactggaaccataggtgccgtatccctagacttttcccctgggacgtcaggatctccaatcgttgacaaaaaaggaaaagttgtaggcctctatggcaatggtgtcgttacaaggagtggagcatatgtgagtgccatagctcagactgaaaaaagcattgaagacaatccagagattgaagatgacatctttcgaaagagaagattgactatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagccatcagggctgaacacaccgggcgggagatcgtggacttaatgtgtcatgccacatttaccatgaggctgctatcaccaatcagggtgccaaattacaacctgatcatcatggacgaagctcattttacagatccagcaagcatagcagctagaggatacatctcaactcgagtggagatgggtgaggcagctggaatttttatgacagccactcctccgggtagcagagatccatttcctcagagtaatgcaccaattatggatgaagaaagagaaattccggaacgttcatggaactccgggcacgagtgggtcacggattttaaaggaaagactgtctggtttgttccaagcataaaagccggaaatgacatagcaacctgcctgagaaagaatggaaagagggtgatacaactcagtaggaagacctttgattctgaatacgtcaagactagaaccaatgactgggatttcgtggtcacaactgacatttcggaaatgggtgccaactttaaagctgagagggttatagaccccagacgctgcatgaaaccagttatactgacagacggcgaagagcgggtgatcctggcaggacccatgccagtgacccactccagtgcagcacaaagaagagggagaataggaaggaatccaaggaatgaaaatgatcaatacatatatatgggagaacccctggaaaatgatgaagactgtgcacactggaaggaagctaagatgctcctagataacatcaacacacctgaaggaattattcccagcatgttcgagccagagcgtgaaaaggtggatgccattgacggtgaatatcgcttgagaggagaagcacggaaaacttttgtggacctaatgagaagaggagacctaccagtctggctggcttataaagtggcatctgaaggtatcaactacgcagacagaagatggtgttttgacggaactagaaacaatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagacgcactagacaacttggcggtgctgcacacggctgaagcgggtggaaaagcatacaatcatgctctcagtgaactaccggagaccctggagacattgcttttgctgacactgttagccacagtcacgggaggaatctttctattcctgatgagcggaaggggtatagggaagatgaccctgggaatgtgttgcataatcacggccagcatcctcttatggtatgcacaaatacaaccacattggatagcagcttcaataatattggaattctttctcatagtcttgcttattccagaaccagaaaagcagaggacaccccaggacaatcaattgacttatgtcatcatagccatcctcacagtggttgcggcaaccatggctaacgaaatgggttttctagaaaaaacaaagaaagacctcggactaggacacattgcaactcagcaacctgagagcaacattctggacatagatctacgtccagcatcagcatggacgttgtatgccgtggctacaacatttatcacaccaatgctgagacatagcattgaaaattcctcagtaaatgtgtccctaacagccatagctaaccaagccacagtgctaatgggtctcgggaaaggatggccattgtcaaaaatggacattggagtccccctccttgccattgggtgttactcacaagtcaaccctataaccctcacagcggctcttcttttattggtagcacattatgccatcataggaccgggacttcaagccaaagcaaccagagaagctcagaaaagagcagcggcgggcatcatgaaaaacccaactgtggatggaataacagtgatagatctagatccaataccctatgatccaaagtttgaaaagcagttgggacaagtaatgctcctagtcctttgcgtgacccaagtgctgatgatgaggactacgtgggctttgtgtgaagccttaactttagcaaccggacctgtgtccacattgtgggaaggaaatccagggagattctggaacacaaccattgcagtgtcaatggcaaacatttttagagggagttaccttgctggagctggacttctcttttctatcatgaagaacacgactagcacgagaagaggaactggcaacataggagaaacactaggagagaaatggaaaagcagactgaacgcattgggaaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggatcttggttgcggcagagggggctggtcatactattgcggaggactgaagaatgtaagggaagttaaaggcttaacaaaaggaggaccaggacatgaagaacctatccctatgtcaacatatgggtggaatctagtacgcttacagagcggagttgacgttttttttgttccaccagagaagtgtgacacattgttgtgtgacataggggaatcatcgccaaatcctacggtagaagcgggacgaacactcagagtccttaacctagtggaaaattggctgaacgataacacccaattttgcgtaaaggttcttaacccgtacatgccctcagtcattgaaagaatggaaaccttacaaaggaaatacggaggagccttggtgagaaatccactctcacggaattccacacatgaaatgtactgggtgtccaatgcttccgggaacgtagtgtcatcagtgaacatgatttcaagaatgctgattaacagattcaccatgagacacaagaaggccacctatgagccagatgtcgacctcggaagcggaacccgcaacattggaattgaaagtgagacaccgaacctagacataattgggaagagaatagaaaaaataaaacaagagcatgaagcgtcatggcactatgaccaagaccacccatacaaaacatgggcttaccatggcagctatgaaacaaaacagactggatcagcatcatccatggtgaatggagtagtcagattgctgacaaaaccctgggacgttgttccaatggtgacacagatggcaatgacagacacaactcctttcggacaacagcgcgtctttaaagagaaggtggatacgagaacccaagaaccaaaagaaggcacaaaaaaactaatgaaaatcacggcagagtggctctggaaagaactaggaaagaagaagacacccagaatgtgcaccagagaagaattcacaaaaaaagtgagaagcaatgcagccttgggggccatatttaccgatgagaacaagtggaaatcggcgcgtgaggctgttgaagataataggttttgggagctggttgacaaggaaagaaacctccatcttgaaggaaaatgtgaaacatgtgtatacaacatgatgggaaaaagagagaaaaaactaggagagtttggtaaagcaagaggcagcagagccatatggtacatgtggctcggagcacgcttcttagagtttgaagccctaggatttttgaatgaagaccactggttctccagagagaactccctgagtggagtggaaggagaagggctgcataaactaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacagtaatggacatcatatcgagaagagaccaaaggggtagtggacaagttgtcacctatggcctcaacactttcaccaacatggaagcacaactaattaggcagatggagggggaaggaatcttcaaaagcatccagcacttgacagcctcagaagaaatcgctgtgcaagattggctagcaagagtagggcgtgaaaggttatcaagaatggccatcagtggagatgattgcgttgtgaaacctttagatgatagatttgcaagagctctaacagctctgaatgacatgggaaaggttaggaaagacatacagcaatgggagccctcaagaggatggaacgactggacacaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaacgccatctgctcggcagtcccgtcacactgggttccaacaagccggacaacctggtccatacacgccagccatgaatggatgacgacggaagacatgttgacagtttggaacagagtgtggatcctagaaaatccatggatggaagacaaaactccagtggaatcatgggaggaaatcccatatctgggaaaaagagaagaccaatggtgcggctcgctgatcgggctgacaagcagagccacctgggcgaagaacatccagacagcaataaaccaagtcagatccctcattggcaatgaggaatacacagattacatgccatccatgaaaagattcagaagagaagaggaagaggcaggagttttgtggtag

SEQ ID NO: 6991 - RNA, 9876 nt, synthetic construct
  misc_feature 1..9876: note = derived and/or modified CDS sequence (wt) from DENV-2__KP012546__SS-prME
  source 1..9876: mol_type = other RNA
actgcaggcataattattatgatgattccaacagtgatggcgttccatttgaccacacgcaacggagaaccacacatgatcgtcagcagacaagagaaagggaaaagtcttctgtttaaaacagagaacggtgtgaacatgtgtaccctcatggccatggaccttggtgaactgtgtgaagacacaatcacttataattgtcctcttcttaggcagaatgaaccagaagacatagactgttggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacaccataggaacgacatatttccaaagagtcctgatcttcatcttactgacagctgtcgctccttcaatgacaatgcgttgtataggaatatcaaatagagactttgtggaaggggtatcaggaggaagctgggttgacatagttttggaacatggaagctgtgtgacgacgatggcgaaaaataaaccaacattggattttgaactgataaaaacagaagccaaacaccccgccactctaaggaagtactgtatagaggcaaagctgaccaacacaacaacagcatctcgctgcccaacacaaggagaacctagcctaaatgaagaacaggacaaaagatttgtttgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacactattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaataaggcttggctggtgcacaggcaatggtttttagacctgccgttaccatggctgcccggagcagacacacaaggatcaaattggatacagaaggagacattggtcactttcaaaaatccccatgcaaagaaacaggatgtcgtcgtattaggatcccaagaaggggccatgcacacagcactcacaggggccacggaaatccaaatgtcatcaggaaacttactgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatctggaaaagagacatgtcttaggtcgcttgattacagtcaacccaattgtcacggaaaaagacagcccagtcaacatagaagcagaacctcctttcggggacagctacatcattataggagtagaaccaggacaactgaaactcagctggtttaagaaaggaagttctattggccaaatgtttgagacaacaatgagaggagcgaagagaatggccattttaggtgacacagcttgggattttggatccctgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgttccctgcggcctcaacccactgagctgaagtactcctggaaaacatggggcaaggcgaaaatgctctccacagagcttcataaccacacttttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaggcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgaaatggacttcgatttctgtgaaggaaccacagtggtggtgactgaggactgtggaaatagaggaccctctttaagaacaactactgcttctggaaaactcataacagagtggtgctgccgatcttgcacattaccaccgctaaggtacagaggtgaggacggatgctggtatggaatggaaattagaccattgaaagagaaagaagagaacttggtcaactctttggtcacagccggacatggacagattgataacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctgctatgacggatgacataggcatgggcgtgacttaccttgccctattagcagccttcaaagtcagaccaacttttgcagctggactactcttaagaaagctgacctccaaggaattgatgatgaccaccataggaatcgtgctcctctcccagagcaccatgccagagactatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtctgtttccccactgcttttaacatcctcacagcagaaagcggattggataccactggcgttgacgatcaaaggcctcaatccaacagccattttcttaacaaccctctcaagaactagcaagaaaaggagctggccactaaatgaggccattatggcagtcgggatggtgagcattttagccagttctctcttaaagaatgatattcccatgacaggaccattagtggctggagggcttctcactgtgtgttacgtgctcactggaagatcggctgatttagaactggagagagctgctgacgtaagatgggaagaacaggcggagatatcaggaagtagtccaattctgtcgataacaatatcggaagatggtagcatgtcgataaaaaatgaagaagaagaacaaacactgaccatactcatcagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggcgctgtcctaatgcataaagggaagagaattgaaccatcatgggcggacgtaaagaaagatctaatatcgtatggaggaggctggaaattagaaggagaatggaaggaaggagaagaagtccaggtcctggcattagagcccggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatacgtgagtgctatagcccagactgaaaaaagcatcgaagacaatccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagttgtggcagctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccattccctcagagcaatgcaccaatcatggatgaagaaagagaaatccctgagcgttcgtggaactctggacatgagtgggttactgattttaaagggaagactgtttggtttgttccgagtataaaagcagggaatgatatagcagcttgcctgagaaagaatggaaagaaggtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgactcactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcagcacgcctgaaggaatcattcccagcatgtttgaaccagagcgcgaaaaggtggatgccattgatggtgaataccgcttgagaggagaagcgaggaaaacttttgtggacctaatgagaagaggagacctaccagtctggttagcctacagagtggcagctgaaggtatcaattacgcagatagaagatggtgctttgatggagtcaagaacaaccaaattttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctaaatctaatcacagagatgggtaggctcccaaccttcatgacccagaaagcaaggaatgcactggataacttagcagtcttgcatacagctgaagcaggcggaagggcgtacaatcatgctctcagtgaactgccggagactctggagacattgcttttgctgacactcttggccgcagtcacgggcggaatcttcctgttcttgatgagcggaaaaggtatagggaagatgaccttgggaatgtgctgcataattacggccagtattctcctatggtatgcacaaatacagccacactggatagcagcttcaataatactggagttttttctcatagtcttgctcattccagaaccagaaaagcagagaacacctcaagataaccaattaacttatgttgtcatagccatccttacagtggtggccgcaaccatggcgaacgagatgggtttcctggaaaaaacaaagaaagatttcggattgggaagcactacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattatcaaaaatggacatcggagttcctcttcttgctatcgggtgctattcacaagtcaaccccataactctcacagcagcccttctcttattggtagcacattatgctatcatagggccaggactccaagcgaaagcaactagagaggcccagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggaccacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaatacaagaaggggaactggcaacacaggagagacgcttggagagaaatggaaaaaccggttgaatgcactggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggttggaatctggtgcgtctacaaagtggagttgatgttttttttactccgccagaaaagtgtgacacattgctgtgtgacataggggagtcgtcaccaaaccccacggttgaagcaggacgaacactcagagttctaaacttagtggaaaattggctgaacaataacacccaattttgcataaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagacgttgacctcggaagtggaacccgcaacatcggaattgaaagtgagacaccaaatttagacataattgggaaaagaatagaaaaaataaaacaggagcatgaaacatcatggcactatgaccaagaccatccatacaaaacgtgggcctaccatggcagctacgaaacaaagcagactggatcagcatcttccatggtgaacggagtggttaggctgctaacaaaaccatgggacgttatccctatggtgacacagatggcaatgacagatacgactccatttggacaacagcgcgttttcaaagagaaagtggatacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgataaggaaaggaatctccatcttgaaggaaagtgtgagacatgtgtatataacatgatgggaaagagagaaaagaagctaggggagttcggtaaagcgaagggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgctgaagccatcttcaaattaacgtaccaaaacaaggtggtgcgtgtgcaaagaccaacaccaaggggcacagtaatggacattatatcgagaagagaccaaagaggtagtggacaagttgttacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggagccctcaagaggatggaatgattggacacaagtgcctttttgttcacaccatttccatgagttaatcatgaaggacggtcgtgtactcgtagttccatgcagaaatcaagatgaactgattggtagggcccgaatttctcagggagccgggtggtccttgcgggaaacagcctgtttggggaagtcttacgcccaaatgtggaacctgatgtacttccacagacgtgaccttaggctggcggcaaatgccatttgctcggcagtcccatcacactgggttccaacaagtcgaacaacctggtccatacacgccacacatgagtggatgacaacagaagacatgctgacagtctggaacagggtgtggattcaagagaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaggaggaagaggcaggagtcttgtggtag

SEQ ID NO: 6992 - RNA, 9876 nt, synthetic construct
  misc_feature 1..9876: note = derived and/or modified CDS sequence (wt) from DENV-2__KP723478__SS-prME
  source 1..9876: mol_type = other RNA
actgcaggcataattattatgatgattccaacagtgatggcgttccatttgaccacacgcaacggagaaccacacatgatcgtcagcagacaagagaaagggaaaagtcttctgtttaaaacagagaacggtgtgaacatgtgtaccctcatggccatggaccttggtgaactgtgtgaagacacaatcacttataattgtcctcttcttaggcagaatgaaccagaagacatagactgttggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacctgggtcttgagacatccaggcttcaccataatggcagcaatcctggcttacaccataggaacgacatatttccaaagagtcctgatcttcatcttactgacagctgtcgctccttcaatgacaatgcgttgtataggaatatcaaatagagactttgtggaaggggtatcaggaggaagctgggttgacatagttttggaacatggaagctgtgtgacgacgatggcgaaaaataaaccaacattggattttgaactgataaaaacagaagccaaacaccccgccactctaaggaagtactgtatagaggcaaagctgaccaacacaacaacagcatctcgctgcccaacacaaggagaacctagcctaaatgaagaacaggacaaaagatttgtttgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacactattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggtttttagacctgccgttaccatggctgcccggagcagacacacaaggatcaaattggatacagaaggagacattggtcactttcaaaaatccccatgcaaagaaacaggatgtcgtcgtattaggatcccaagaaggggccatgcacacagcactcacaggggccacggaaatccaaatgtcatcaggaaacttactgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccatgcaagatcccttttgaaataatggatctggaaaagagacatgtcttaggtcgcttgattacagtcaacccaattgtcacggaaaaagacagcccagtcaacatagaagcagaacctcctttcggggacagctacatcattataggagtagaaccaggacaactgaaactcagctggtttaagaaaggaagttctattggccaaatgtttgagacaacaatgagaggagcgaagagaatggccattttaggtgacacagcttgggattttggatccctgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgttccctgcggcctcaacccactgagctgaagtactcctggaaaacatggggcaaggcgaaaatgctctccacagagcttcataaccacacttttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaggcctcttttattgaagttaaaagctgccactggccaaagtcacacactctctggagtaatggagtgctagaaagtgagatgataattccaaagaattttgcaggaccaatgtcacaacacaattacagaccaggctatcatacacaaacggcaggaccctggcatctaggcaggcttgaaatggacttcgatttctgtgaaggaaccacagtggtggtgactgaggactgtggaaatagaggaccctctttaagaacaactactgcttctggaaaactcataacagagtggtgctgccgatcttgcacattaccaccgctaaggtacagaggtgaggacggatgctggtatggaatggaaattagaccattgaaagagaaagaagagaacttggtcaactctttggtcacagccggacatggacagattgataacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctgctatgacggatgacataggcatgggcgtgacttaccttgccctattagcagccttcaaagtcagaccaacttttgcagctggactactcttaagaaagctgacatccaaggaattgatgatgaccaccataggaatcgtgctcctctcccagagcaccatgccagagactatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtctgtttccccactgcttttaacatcctcacagcagaaagcggattggataccactggcgttgacgatcaaaggcctcaatccaacagccattttcttaacaaccctctcaagaactagcaagaaaaggagctggccactaaatgaggccattatggcagtcgggatggtgagcattttagccagttctctcttaaagaatgatattcccatgacaggaccattagtggctggagggcttctcactgtgtgttacgtgctcactggaagatcggctgatttagaactggagagagctgctgacgtaagatgggaagaacaggcggagatatcaggaagtagtccaattctgtcgataacaatatcggaagatggtagcatgtcgataaaaaatgaagaagaagaacaaacactgaccatactcatcagaacaggactgctggtgatatcaggactttttcccgtgtcaacaccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggcgctgtcctaatgcataaagggaagagaattgaaccatcatgggcggacgtaaagaaagatctaatatcgtatggaggaggctggaaattagaaggagaatggaaggaaggagaagaagtccaggtcctggcattagagcccggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatacgtgagtgctatagcccagactgaaaaaagcatcgaagacaatccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagttgtggcagctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccattccctcagagcaatgcaccaatcatggatgaagaaagagaaatccctgagcgttcgtggaactctggacatgagtgggttactgattttaaagggaagactgtttggtttgttccgagtataaaagcagggaatgatatagcagcttgcctgagaaagaatggaaagaaggtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgactcactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcagcacgcctgaaggaatcattcccagcatgtttgaaccagagcgcgaaaaggtggatgccattgatggtgaataccgcttgagaggagaagcgaggaaaacttttgtggacctaatgagaagaggagacctaccagtctggttagcctacagagtggcagctgaaggtatcaattacgcagatagaagatggtgctttgatggagtcaagaacaaccaaattttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctaaatctaatcacagagatgggtaggctcccaaccttcatgacccagaaagcaaggaatgcactggataacttagcagtcttgcatacagctgaagcaggcggaagggcgtacaatcatgctctcagtgaactgccggagactctggagacattgcttttgctgacactcttggccgcagtcacgggcggaatcttcctgttcttgatgagtggaaaaggtatagggaagatgaccctgggaatgtgctgcataatcacagccagtattcttctatggtatgcacaaatacagccacactggatagcagcttcaataatactggagttttttctcatagtcttgctcattccagaaccagaaaagcagagaacacctcaagataaccaattaacttatgttgtcatagccatccttacagtggtggccgcaaccatggcgaacgagatgggtttcctggaaaaaacaaagaaagatttcggattgggaagcactacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttcctcttctcgctatcgggtgctattcacaagtcaaccccataactctcacagcagcccttctcttattggtagcacattatgctatcatagggccaggactccaagcgaaagcaactagagaggcccagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggaccacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaatacaagaaggggaactggcaacacaggagagacgcttggagagaaatggaaaaaccggttgaatgcactggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggttggaatctggtgcgtctacaaagtggagttgatgttttttttactccgccagaaaagtgtgacacattgctgtgtgacataggggagtcgtcaccaaaccccacggttgaagcaggacgaacactcagagttctaaacttagtggaaaattggctgaacaataacacccaattttgcataaaggttctcaacccatacatgccctcagttatagaaaagatggaagcgctgcaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagacgttgacctcggaagtggaacccgcaacatcggaattgaaagtgagacaccaaatttagacataattgggaaaagaatagaaaaaataaaacaggagcatgaaacatcatggcactatgaccaagaccatccatacaaaacgtgggcctaccatggcagctacgaaacaaagcagactggatcagcatcttccatggtgaacggagtggttaggctgctaacaaaaccatgggacgttatccctatggtgacacagatggcaatgacagatacgactccatttggacaacagcgcgtattcaaagagaaagtggatacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgataaggaaaggaatctccatcttgaaggaaagtgtgagacatgtgtatataacatgatgggaaagagagaaaagaagctaggggagttcggtaaagcgaagggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgctgaagccatcttcaaattaacgtaccaaaacaaggtggtgcgtgtgcaaagaccaacaccaaggggcacagtaatggacattatatcgagaagagaccaaagaggtagtggacaagttgttacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggagccctcaagaggatggaacgattggacacaagtgcctttttgttcacaccatttccatgagttaatcatgaaggacggtcgtgtactcgtagttccatgcagaaatcaagatgaactgattggtagggcccgaatttctcagggagccgggtggtccttgcgggaaacagcctgtttggggaagtcttacgcccaaatgtggaacctgatgtacttccacagacgtgaccttaggctggcggcaaatgccatttgctcggcagtcccatcacactgggttccaacaagtcgaacaacctggtccatacacgccacacatgagtggatgacaacagaagacatgctgacagtctggaacagggtgtggattcaagagaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaggaggaagaggcaggagtcttgtggtag

SEQ ID NO: 6993 - RNA, 9876 nt, synthetic construct
  misc_feature 1..9876: note = derived and/or modified CDS sequence (wt) from DENV-2__KP723479__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagattgctggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacgtgggtcttgagacatccaggcttcaccataatggcagcaatcctggcttacaccataggaacgacatacttccaaagagtcctgatcttcatcttactgacagctgtcgctccttcaatgacaatgcgttgtataggaatatcaaatagagactttgtggaaggggtatcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccatcgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgtaggctgagaatggacaaattacaactcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaatcgtcacagagaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttaggaggggtgttcacatccataggaaaggccctccaccaagtctttggagcaatttatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactagagaatctgatgtggaaacaaataacaccagaactgaatcacattttatcagaaaatgaggtaaagttgactatcatgacaggagacattaaaggaatcatgcaggcaggaaaacgatccctacggcctcaacccactgagttgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtatttaccaccaacatatggctgaaaatgaaagaaaggcaggatgtattttgtgactcaaaactcatgtcagcagccataaaagacagcagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccctctttaagaacaactactgcttctggaaaactcataacagagtggtgttgccgatcttgcacactaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattattagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtgctcctctcccaggccaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactaacaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtggtatcaggactctttcccgtgtcaacaccaatcacggcagctgcatggtacctgtgggaagtgaaaaaacaacgagcaggagtattgtgggatgtcccttcacccccacctgtgggaaaggccgaactggaggatggagcctacagaatcaagcagaaagggattctaggatactcgcagatcggagctggagtttacaaagaaggaacatttcacacaatgtggcatgtcacacgtggtgctgttctaatgcataaagggaagagaattgaaccatcatgggcggacgtcaagaaagatctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggtgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccatccaggagcaggaaaaacaaagagataccttccagcaatagtcagagaagccataaaacgaggcttgagaacactaatcctggcccccactagagtggtggcggctgaaatggaagaagctctcagaggacttccaataagataccaaaccccagctatcagagctgagcacactgggcgggagattgtggatctaatgtgtcacgccacatttaccatgaggctgctatcaccaattagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcagggaatgacatagcagcttgcctgagaaagaatggaaagaaagtgatacaactcagcaggaagacttttgactctgaatatatcaagactaggaccaatgattgggactttgtggtcacgacagacatttcagagatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagccaaaatgcttctagacaacatcaacacgcctgaaggaatcattcccagcatgttcgaaccagagcgcgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggagttcgcagctggaagaaagtccctgaccctgaatctaatcacagagatgggtaggctcccaaccttcatgacccagaaagcaaggaatgcactggataacttagcagtcttgcatacagctgaagcaggcggaagggcgtacaatcatgctcttagtgaactgccggagactctggagacattgcttttactgacactcttggccacagtcacgggcggaatcttcctgttcttgatgagcggaaaaggtatagggaagatgaccttgggaatgtgctgcataattacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagaacaacatcctggacatagatctacgtcctgcatcagcttggactctatatgccgtggcaacaactttcatcacaccaatgttgagacatagcattgaaaattcctcagtgaatgtgtctctaacagctattgccaaccaagccacggtgttaatgggtcttgggaaaggatggccattatcaaaaatggacatcggagttccccttctcgctatcgggtgctattcacaagtcaaccccataactctcacagcagcccttctcctattggtagcacattatgctatcatagggccaggactccaagcgaaagcaactagagaagctcagaaaagagcagcagcgggcatcatgaaaaacccaactgtggatggaataacagtgattgacctagatccaataccctatgacccaaagtttgaaaagcagttgggacaagtaatgctcttagtcctctgcgtgactcaagtattgatgatgaggaccacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacgggagagacgcttggagagaaatggaaaaaccggttgaatgcattgggaaagagtgaattccagatctataagaaaagtggaatccaggaagtggatagaaccttagcaaaagaaggcatcaaaagaggagaaacggaccatcatgctgtgtcgcgaggctcggcgaaactgagatggttcgtcgagagaaacctggtcacaccagaagggaaagtagtggaccttggttgtggcaggggaggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccactgttgaagcaggacgaacactcagagttctaaacctagtggaaaattggctgaacaataacacccaattttgcataaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaatatgatttcaagaatgttgatcaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgcgttttcaaagagaaagtggacacgagaacccaagaaccgaaagaaggcacgaaaaaactaatgaagatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagcggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggatttttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaactaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagttacagaagaaattgcagtgaaaaactggttagtaagagtggggcgtgagaggttatcaagaatggccattagtggagatgactgtgttgtgaaacccttagatgacaggtttgcaagcgctctaacagctctaaatgacatgggaaaggttaggaaagacatacaacaatgggaaccttcaagaggatggaacgactggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacgcatgagtggatgacaacagaagacatgctgacagtctggaacagggtgtggatccaagaaaacccatggatggaagacaaaactccagtggagtcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 6994 - RNA, 9876 nt, synthetic construct
  misc_feature 1..9876: note = derived and/or modified CDS sequence (wt) from DENV-2__KT187554__SS-prME
  source 1..9876: mol_type = other RNA
actgcaggcataattattatgatgattccaacagtgatggcgttccatttgaccacacgcaacggagaaccacacatgatcgtcagcagacaagagaaagggaaaagtcttctgtttaaaacagagaacggtgtgaacatgtgtaccctcatggccatggaccttggtgaactgtgtgaagacacaatcacttataattgtcctcttcttaggcagaatgaaccagaagacatagactgttggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacaccataggaacgacatattttcaaagagtcctgatcttcatcttactgacagctgtcgctccttcaatgacaatgcgttgtataggaatatcaaatagagactttgtggaaggggtatcaggaggaagctgggttgacatagttttggaacatggaagctgtgtgacgacgatggcgaaaaataaaccaacattggattttgaactgataaaaacagaagccaaacaccccgccactctaaggaagtactgtatagaggcaaagctgaccaacacaacaacagcatctcgctgcccaacacaaggagaacctagcctaaatgaagaacaggacaaaagatttgtttgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacactattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggtttttagacctgccgttaccatggctgcccggagcagacacacaaggatcaaattggatacagaaggagacattggtcactttcaaaaatcctcatgcaaagaaacaggatgtcgtcgtattaggatcccaagaaggggccatgcacacagcactcacaggggccacggaaatccaaatgtcatcaggaaacttactgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggctctccatgcaagatcccttttgaaataatggatctggaaaagagacatgtcttaggtcgcttgattacagtcaacccaattgtcacggaaaaagacagcccagtcaacatagaagcagaacctcctttcggggacagctacatcattataggagtagaaccaggacaactgaaactcagctggtttaagaaaggaagttctattggccaaatgtttgagacaacaatgagaggagcgaagagaatggccattttaggtgacacagcttgggattttggatccctgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgttccctgcggcctcaacccactgagctgaagtactcctggaaaacatggggcaaggcgaaaatgctctccacagagcttcataaccacacttttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaggcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgaaatggacttcgatttctgtgaaggaaccacagtggtggtgactgaggactgtggaaatagaggaccctctttaagaacaactactgcttctggaaaactcataacagagtggtgctgccgatcttgcacattaccaccgctaaggtacagaggtgaggacggatgctggtatggaatggaaattagaccattgaaagagaaagaagagaacttggtcaactctttggtcacagccggacatggacagattgataacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctgctatgacggatgacataggcatgggcgtgacttaccttgccctattagcagccttcaaagtcagaccaacttttgcagctggactactcttaagaaagctgacctccaaggaattgatgatgaccaccataggaatcgtgctcctctcccagagcaccatgccagagactatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtctgtttccccactgtttttaacatcctcacagcagaaagcggattggataccactggcgttgacgatcaaaggcctcaatccaacagccattttcttaacaaccctctcaagaactagcaagaaaaggagctggccactaaatgaggccattatggcagtcgggatggtgagcattttagccagttctctcttaaagaatgatattcccatgacaggaccattagtggctggagggcttctcactgtgtgttacgtgctcactggaagatcggctgatttagaactggagagagctgctgacgtaagatgggaagaacaggcggagatatcaggaagtagtccaattctgtcgataacaatatcggaagatggtagcatgtcgataaaaaatgaagaagaagaacaaacactgaccatactcatcagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggcgctgtcctaatgcataaagggaagagaattgaaccatcatgggcggacgtaaagaaagatctaatatcgtatggaggaggctggaaattagaaggagaatggaaggaaggagaagaagtccaggtcctggcattagagcccggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatacgtgagtgctatagcccagactgaaaaaagcatcgaagacaatccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagttgtggcagctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccattccctcagagcaatgcaccaatcatggatgaagaaagagaaatccctgagcgttcgtggaactctggacatgagtgggttactgattttaaagggaagactgtttggtttgttccgagtataaaagcagggaatgatatagcagcttgcctgagaaagaatggaaagaaggtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgactcactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcagcacgcctgaaggaatcattcccagcatgtttgaaccagagcgcgaaaaggtggatgccattgatggtgaataccgcttgagaggagaagcgaggaaaacttttgtggacctaatgagaagaggagacctaccagtctggttagcctacagagtggcagctgaaggtatcaattacgcagatagaagatggtgctttgatggagtcaagaacaaccaaattttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctaaatctaatcacagagatgggtaggctcccaaccttcatgacccagaaagcaaggaatgcactggataacttagcagtcttgcatacagctgaagcaggcggaagggcgtacaatcatgctctcagtgaactgccggagactctggagacattgcttttgctgacactcttggccgcagtcacgggcggaattttcctgttcttgatgagtggaaaaggtatagggaagatgaccctgggaatgtgctgcataatcacagccagtattcttctatggtatgcacaaatacagccacactggatagcagcttcaataatactggagttttttctcatagtcttgctcattccagaaccagaaaagcagagaacacctcaagataaccaattaacttatgttgtcatagccatccttacagtggtggccgcaaccatggcgaacgagatgggtttcctggaaaaaacaaagaaagatttcggattgggaagcactacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttcctcttctcgctatcgggtgctattcacaagtcaaccccataactctcacagcagcccttctcttattggtagcacattatgctatcatagggccaggactccaagcgaaagcaactagagaggcccagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggaccacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaatacaagaaggggaactggcaacacaggagagacgcttggagagaaatggaaaaaccggttgaatgcactggggaagagtgaattccagatctataagaaaagtggaatccaagaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggttggaatctggtgcgtctacaaagtggagttgatgttttttttactccgccagaaaagtgtgacacattgctgtgtgacataggggagtcgtcaccaaaccccacggttgaagcaggacgaacactcagagttctaaacttagtggaaaattggctgaacaataacacccaattttgcataaaggttctcaacccatacatgccctcagttatagaaaagatggaagcgctgcaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagacgttgacctcggaagtggaacccgcaacatcggaattgaaagtgagacaccaaatttagacataattgggaaaagaatagaaaaaataaaacaggagcatgaaacatcatggcactatgaccaagaccatccatacaaaacgtgggcctaccatggcagctacgaaacaaagcagactggatcagcatcttccatggtgaacggagtggttaggctgctaacaaaaccatgggacgttatccctatggtgacacagatggcaatgacagatacgactccatttggacaacagcgcgttttcaaagagaaagtggatacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgataaggaaaggaatctccatcttgaaggaaagtgtgagacatgtgtatataacatgatgggaaagagagaaaagaagctaggggagttcggtaaagcgaagggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagagagaaggaggagcaatgtacgccgatgacaccgcaggatgggacacaagaatcacactagaggacttgaaaaatgaagaaatggtgacaaaccacatggaaggagaacacaagaaacttgctgaagccatcttcaaattaacgtaccaaaacaaggtggtgcgtgtgcaaagaccaacaccaaggggcacagtaatggacattatatcgagaagagaccaaagaggtagtggacaagttgttacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggagccctcaagaggatggaacgattggacacaagtgcctttttgttcacaccatttccatgagttaatcatgaaggacggtcgtgtactcgtagttccatgcagaaatcaagatgaactgattggtagggcccgaatttctcagggagccgggtggtccttgcgggaaacagcctgtttggggaagtcttacgcccaaatgtggaacctgatgtacttccacagacgtgaccttaggctggcggcaaatgccatttgctcggcagtcccatcacactgggttccaacaagtcgaacaacctggtccatacacgccacacatgagtggatgacaacagaagacatgctgacagtctggaacagggtgtggattcaagagaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaggaggaagaggcaggagtcttgtggtag

SEQ ID NO: 6995 - RNA, 9876 nt, synthetic construct
  misc_feature 1..9876: note = derived and/or modified CDS sequence (wt) from DENV-2__KT187557__SS-prME
  source 1..9876: mol_type = other RNA
actgcaggcataattattatgatgattccaacagtgatggcgttccatttgaccacacgcaacggagaaccacacatgatcgtcagcagacaagagaaagggaaaagtcttctgtttaaaacagagaacggtgtgaacatgtgtaccctcatggccatggaccttggtgaactgtgtgaagacacaatcacttataattgtcctcttcttaggcagaatgaaccagaagacatagactgttggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacctgggtcttgagacatccaggcttcaccataatggcagcaatcctggcttacaccataggaacgacatatttccaaagagtcctgatcttcatcttactgacagctgtcgctccttcaatgacaatgcgttgtataggaatatcaaatagagactttgtggaaggggtatcaggaggaagctgggttgacatagttttggaacatggaagctgtgtgacgacgatggcgaaaaataaaccaacattggattttgaactgataaaaacagaagccaaacaccccgccactctaaggaagtactgtatagaggcaaagctgaccaacacaacaacagcatctcgctgcccaacacaaggagaacctagcctaaatgaagaacaggacaaaagatttgtttgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacactattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggtttttagacctgccgttaccatggctgcccggagcagacacacaaggatcaaattggatacagaaggagacattggtcactttcaaaaatccccatgcaaagaaacaggatgtcgtcgtattaggatcccaagaaggggctatgcacacagcactcacaggggccacggaaatccaaatgtcatcaggaaacttactgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccatgcaagatcccttttgaaataatggatctggaaaagagacatgtcttaggtcgcttgattacagtcaacccaattgtcacggaaaaagacagcccagtcaacatagaagcagaacctcctttcggggacagctacatcattataggagtagaaccaggacaactgaaactcagctggtttaagaaaggaagttctattggccaaatgtttgagacaacaatgagaggagcgaagagaatggccattttaggtgacacagcttgggattttggatccctgggaggggtgttcacgtccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgttccctgcggcctcaacccactgagctgaagtactcctggaaaacatggggcaaggcgaaaatgctctccacagagcttcataaccacacttttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaggcctcttttattgaagttaaaagctgccactggccaaagtcacacactctctggagtaatggagtgctagaaagtgagatgataattccaaagaattttgcaggaccaatgtcacaacacaattacagaccaggctatcatacacaaacggcaggaccctggcatctaggcaggcttgaaatggacttcgatttctgtgaaggaaccacagtggtggtgactgaggactgtggaaatagaggaccctctttaagaacaactactgcttctggaaaactcataacagagtggtgctgccgatcttgcacattaccaccgctaaggtacagaggtgaggacggatgctggtatggaatggaaattagaccattgaaagagaaagaagagaacttggtcaactctttggtcacagccggacatggacagattgataacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctgctatgacggatgacataggcatgggcgtgacttaccttgccctattagcagccttcaaagtcagaccaacttttgcagctggactactcttaagaaagctgacctccaaggaattgatgatgaccaccataggaatcgtgctcctctcccagagcaccatgccagagactatacttgaactgactgacgcgttggccttggggatgatggttctcaaaatagtgagaaacatggaaaagtatcaactagcagtgactatcatggccatcttgtgcgtcccaaatgcagtgatattacaaaacgcatggaaagtgagttgcacaacactggcagtggtgtctgtttccccactgcttttaacatcctcacagcagaaagcggattggataccactggcgttgacgatcaaaggcctcaatccaacagccattttcttaacaaccctctcaagaactagcaagaaaaggagctggccactaaatgaggccattatggcagtcgggatggtgagcattttagccagttctctcttaaagaatgatattcccatgacaggaccattagtggctggagggcttctcactgtgtgttacgtgctcactggaagatcggctgatttagaactggagagagctgctgacgtaagatgggaagaacaggcggagatatcaggaagtagtccaattctgtcgataacaatatcggaagatggtagcatgtcgataaaaaatgaagaagaagaacaaacactgaccatactcatcagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggcgctgtcctaatgcataaagggaagagaattgaaccatcatgggcggacgtaaagaaagatctaatatcgtatggaggaggctggaaattagaaggagaatggaaggaaggagaagaagtccaggtcctggcattagagcccggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatacgtgagtgctatagcccagactgaaaaaagcatcgaagacaatccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagttgtggcagctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccattccctcagagcaatgcaccaatcatggatgaagaaagagaaatccctgagcgttcgtggaactctggacatgagtgggttactgattttaaagggaagactgtttggtttgttccgagtataaaagcagggaatgatatagcagcttgcctgagaaagaatggaaagaaggtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgactcactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcagcacgcctgaaggaatcattcccagcatgtttgaaccagagcgcgaaaaggtggatgccattgatggtgaataccgcttgagaggagaagcgaggaaaacttttgtggacctaatgagaagaggagacctaccagtctggttagcctacagagtggcagctgaaggtatcaattacgcagatagaagatggtgctttgatggagtcaagaacaaccaaattttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctaaatctaatcacagagatgggtaggctcccaaccttcatgacccagaaagcaaggaatgcactggataacttagcagtcttgcatacagctgaagcaggcggaagggcgtacaatcatgctctcagtgaactgccggagactctggagacattgcttttgctgacactcttggccgcagtcacgggcggaatcttcctgttcttgatgagtggaaaaggtatagggaagatgaccctgggaatgtgctgcataatcacagccagtattcttctatggtatgcacaaatacagccacactggatagcagcttcaataatactggagttttttctcatagtcttgctcattccagaaccagaaaagcagagaacacctcaagataaccaattaacttatgttgtcatagccatccttacagtggtggccgcaaccatggcgaacgagatgggtttcctggaaaaaacaaagaaagatttcggattgggaagcactacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttcctcttctcgctatcgggtgctattcacaagtcaaccccataactctcacagcagcccttctcttattggtagcacattatgctatcatagggccaggactccaagcgaaagcaactagagaggcccagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggaccacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaatacaagaaggggaactggcaacacaggagagacgcttggagagaaatggaaaaaccggttgaatgcactggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaagggaggaccaggacacgaagaacccattcccatgtcaacatatggttggaatctggtgcgtctacaaagtggagttgatgttttttttactccgccagaaaagtgtgacacattgctgtgtgacataggggagtcgtcaccaaaccccacggttgaagcaggacgaacactcagagttctaaacttagtggaaaattggctgaacaataacacccaattttgcataaaggttctcaacccatacatgccctcagttatagaaaagatggaagcgctgcaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagacgttgacctcggaagtggaacccgcaacatcggaattgaaagtgagacaccaaatttagacataattgggaaaagaatagaaaaaataaaacaggagcatgaaacatcatggcactatgaccaagaccatccatacaaaacgtgggcctaccatggcagctacgaaacaaagcagactggatcagcatcttccatggtgaacggagtggttaggctgctaacaaaaccatgggacgttatccctatggtgacacagatggcaatgacagatacgactccatttggacaacagcgcgttttcaaagagaaagtggatacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgataaggaaaggaatctccatcttgaaggaaagtgtgagacatgtgtatataacatgatgggaaagagagaaaagaagctaggggagttcggtaaagcgaagggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgctgaagccatcttcaaattaacgtaccaaaacaaggtggtgcgtgtgcaaagaccaacaccaaggggcacagtaatggacattatatcgagaagagaccaaagaggtagtggacaagttgttacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggagccctcaagaggatggaacgattggacacaagtgcctttttgttcacaccatttccatgagttaatcatgaaggacggtcgtgtactcgtagttccatgcagaaatcaagatgaactgattggtagggcccgaatttctcagggagccgggtggtccttgcgggaaacagcctgtttggggaagtcttacgcccaaatgtggaacctgatgtacttccacagacgtgaccttaggctggcggcaaatgccatttgctcggcagtcccatcacactgggttccaacaagtcgaacaacctggtccatacacgccacacatgagtggatgacaacagaagacatgctgacagtctggaacagggtgtggattcaagagaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaggaggaagaggcaggagtcttgtggtag

SEQ ID NO: 6996 - RNA, 9876 nt, synthetic construct
  misc_feature 1..9876: note = derived and/or modified CDS sequence (wt) from DENV-2__JQ045670__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagttctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggagaggagcatgcggtcggaaatgacacaggaaaacatggcaaggaaatcaaagtaacaccacagagttccatcacagaagcagaattgacaggttatggcaccgtcacgatggagtgctccccgaggacaggccttgacttcaatgagatggtgttgctgcagatggaaaataaagcttggctggtgcataggcaatggttcctagacctgccattaccatggctgcccggagcggataaacaagagtcaaattggatacagaaagaaacattggtcactttcaaaaatccccatgcgaagaaacaggatgttgttgttctagggtcccaagaaggggccatgcatacagcactcacaggggccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcttgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattttagcggaaaatgaggtgaagttgactattatgacaggagacatcaaaggaatcatgcaggcaggaaaacgatctttgcggcctcagcccactgagctaaagtattcatggaaaacatggggtaaagcgaaaatgctctccacagagtcttataaccaaacctttctcattgatggccccgagacggcagaatgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctcaggaaaactcataacagaatggtgctgccgatcttgcacactaccacccctaagatacagaggtgaagatgggtgctggtacgggatggaaatcagaccattgaaagagaaagaagaaaatctggttaactccctggtcacagccggacatgggcaggttgacaatttttcactgggagtcttgggaatggcattgttcttggaggaaatgcttaggacccgagtaggaacgaaacatgcaatactactagttgcagtttcttttgtgacactgatcacagggaacatgtccttcaaagacctaggaagagtggtggttatggtaggcgctgcaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaactgactgacgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttctgacatcctcacagcaaaaaacggattggataccattagcattgacaatcaagggtctcaatccaacagctatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggaagatcggctgatttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggtgctgttctaatgcataaaggaaaaaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaattatcgacaaaaaaggaaaagttgtgggtctttatggtaatggtgttgtcacaaggagtggagcatatgtaagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggcttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccaggaagtagagatccatttcctcagagcaatgcaccaatcatggatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaatatcgtttgagaggagaagcaaggaaaacctttgtggacttaatgaggagaggagacttaccagtctggttggcttacaaagtggcagctgaaggcatcaactatgcagacagaaggtggtgttttgatgggattaagaacaaccaaatcctggaagaaaatgtggaagttgaaatctggacaaaagaaggggaaaggaagaaattgaaacccagatggttggatgctaggatctactctgacccactggcgctaaaagagttcaaagaattcgcagccggaagaaagtctctaaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactccttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaactgacctacgttgtcatagccatcctcacagtggtggccgcaaccatggcaaacgagatgggtttcctagaaaaaacgaagaaggattttggattaggaagcattgcaacccagcaacccgagagcaacatcctggacatagacctacgtcccgcatcagcttggacgctgtatgccgtggctacaacattcgtcacaccaatgctgagacatagcattgagaattcctcagtgaatgtatccctaacagctatagccaaccaagcaacagtgttaatgggtctagggaaaggatggccattgtcaaagatggacatcggagttccccttctcgccatcggatgttactcacaagtcaaccccataactctcacagcagctctcctcttattggtagcgcattatgccatcatagggccaggacttcaagcaaaagcaaccagagaagcccagaaaagagcagcggcgggcatcatgaaaaatccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggctttaaccttagctacagggcccatctccacactgtgggaaggaaatccaggaaggttctggaacactaccattgcggtgtcaatggctaacatctttagagggagttacttggctggagctggacttctcttttctattatgaagaacacaaccaacacaagaaggggaactggcaacataggagagacgcttggagagaaatggaaaagccgattgaacgcactgggaaaaagtgaattccagacctacaagaaaagtggaatccaggaagtggatagaaccttagcaaaagaaggcatcaaaagaggagaaacggaccatcacgctgtgtcgcgaggctcggcaaaactgagatggttcgttgagagaaacctggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaactggttgaacaacaacactcaattttgcataaaagttctcaacccatatatgccctcagttatagaaaaaatggaagcactgcaaaggaaatacggaggagccttagtgaggaatgatctctcacgaaattccacacatgagatgtactgggtatccaatgcttctgggaacatagtgtcatcagtgaatatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggttaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaaactaggggaattcggcaaggcaaaaggcagcagagccatatggtacatgtggcttggagctcgcttcctggagtttgaagccctaggattcctaaatgaagatcactggttctctagagagaactccctaagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgcgtgcaaaggccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgatcggcagagcccgaatctcccaaggagcagggtggtctttgcgggaaacggcctgtttggggaagtcttacgcccaaatgtggagtttgatgtatttccacaggcgtgacctcaggctagcggcaaatgccatttgctcggcagtgccatcacactgggttccaacaagtcggacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgtggctcattgattgggttaacaagcagggccacatgggcaaagaacatccaagcagcaataaatcaggttagatctcttataggtaatgaggaatacacagattacatgccatccatgaaaagattcagaagagaagaggaagaagcaggagtcctgtggtaa

SEQ ID NO: 6997 - RNA, 9876 nt, synthetic construct
  misc_feature 1..9876: note = derived and/or modified CDS sequence (wt) from DENV-2__JQ045686__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacttacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagtaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttggaacatggaagctgtgtgacgacgatggcaaaaaacaaaccaacgttggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaaggggggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggccaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaggagtcaaattggatacagaaagaaacattggtcactttcaaaaatccccatgcgaagaaacaggacgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcttgggactttggatccctaggaggagtgttcacatctataggaaaagctctccaccaagtctttggagcaatctatggagctgccttcagtggggtttcatggaccatgaaaatcctcataggagtcattatcacatggataggaatgaactcacgcagcacctcactgtctgtgtcattagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattataacaggagacatcaaaggaatcatgcaggcaggaaaacgatctttgcggcctcagcccactgagctaaagtactcatggaaaacatggggtaaagcaaaaatgctctccacagagtcttataatcaaacctttctcattgatggccccgagacggcagagtgccccaacacaaatagagcctggaactcgttggaggttgaagactacggctttggagtgttcaccaccaatatatggctaaaattgaaagaaaaacaggatgcattctgcgactcaaaactcatgtcggcggctataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttaatttctgtgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccactgaaagagaaagaagaaaatctggttaactctttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaatatgtccttcaaagacctaggaagagtggtggttatggtaggcgctacaatgacggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaactgactgacgcgttagccttaggcatgatggtccttaaaatagtaagaaacatggaaaagtatcaattagcagtgactatcatggctatcttgtgcgtcccaaacgcagtgatattacagaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggggggctcctcactgtgtgctacgtgctcactggaagatcggctgatttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatacttattagaacaggattgctggtgatctcaggactttttcctatatcaataccaatcacggcagcggcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacccggtcttttcaaaactaacaccggaacaataggagctgtatccctggacttttcccctggaacgtcaggatctccaatcatcgacaaaaaaggaaaagttgtgggtctttatggtaatggtgttgtcacaaggagtggagcatatgtgagcgccatagcccaaactgaaaaaagcattgaagacaaccccgagattgaagatgacattttccgaaagagaagactgaccatcatggacctccacccaggagcgggaaagacgaaaagataccttccagccatagtcagagaagccataaaacggggtttgagaacgttaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgacatagcagcttgcctgagaaaaaatggaaagaaagtaatacaacttagtaggaagacttttgattctgagtatgtcaagactagaaccaatgattgggatttcgtggtcacgacagacatttcagaaatgggtgccaatttcaaagctgagagggttatagaccccagacgctgcatgaaaccagtcatactaacagatggtgaggagcgggtgattctggcaggacccatgccagtgacccattctagtgcagcacaaagaagagggagaataggaagaaatccaaaaaatgaaaatgaccagtacatatacatgggagaacctctggaaaatgatgaagactgcgcacactggaaagaagccaaaatgctcctagacaacattaacacaccagaaggaattattcctagtatgtttgaaccagagcgtgaaaaagtggatgccattgttggtgaataccgcttgagaggagaagcaaggaaaacgtttgtggacttaatgaggagaggagacttaccagtctggttggcttacaaagtggcagctgaaggcattaactatgcagacagaaggtggtgttttgatggaattaagaacaaccaaatcctggaagaaaatatggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaactttcatgactcagaagacaagagacgcactggacaacctagcagtgctgcacacggctgaagcaggtggaagggcgtacaatcatgctctcagtgaactgccggagaccctagagacactgcttttactgacgctactggctacagtcacaggagggatctttttattcttgatgagtggaaggggcatagggaagatgaccctgggaatgtgctgcataatcacggctagcatccttctatggtacgcacaaatacagccacactggatagcagcttcaataatactggagttttttcttatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccaacaacccgagagcaacatcctggacatagacctacgtcccgcatcagcttggacgctgtatgccgtggctacaacatttgttacaccaatgctgagacatagcattgagaattcttcagtgaatgtatccttaacagctatagccaaccaagcgacagtgttaatgggcctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactagtcctctgtgtgactcaagtattgatgatgaggactacatgggctctgtgtgaggccttaaccttagctacagggcccatctccacactgtgggaaggaaatccaggaaggttctggaacactaccattgcggtgtcaatggctaacatttttagagggagttacttggctggagctggacttctcttttccattatgaagaacacaaccaatacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaatgtaagagaagtgaaaggcctaacaaaaggaggaccaggacacgaagaacccatccctatgtcaacatatgggtggaatctggtgcgccttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatacggaggagccttagtgagaaatccactctcacgaaattccacacacgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgagataccaaacctagacataattgggaaaagaatagaaaaaataaagcaagagcatgaaacatcatggcactacgaccaagaccacccatacaaaacgtgggcatatcatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaggatcactggttctctagagagaactccctgagtggagtggaaggagaagggctgcacaagctaggttacattctaagagatgtgagcaagaaagagggaggagccatgtacgccgacgacacagcaggatgggacacaagagtcacactagaagacctaaaaaatgaagaaatggtaacaaatcatatggaaggagaacataagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatacttttaccaatatggaagcccaattaatcagacagatggagggagaaggagtctttaaaaacatccagcacctgacagtcacagaagaagttgccgtgaaaaactggttggcaagagtggggcgtgaaaggttgtcaagaatggccatcagtggagatgattgtgttgtgaaacctttagatgacaggttcgcaaacgctttgacagccctaaatgacatgggaaagattagaaaagatatacaacagtgggaaccttcaagaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaaatcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgatcgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtag

SEQ ID NO: 6998 - RNA, 9876 nt, synthetic construct
  misc_feature 1..9876: note = derived and/or modified CDS sequence (wt) from DENV-2__KU094070__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaatggttggaagacaaaatcacgtacaagtgtcctcttctcaggcagaatgaaccagaagacatagattgttggtgcaactctacgtccacatgggtaacttatgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggattatttggaaaaggaagcattgtgacctgtgctatgttcacatgcaaaaagatcatgaaaggaaaagtcgtgcaaccagaaaacttggaatacaccattgtgataacacctcactcaggggaagagcatgcagtcggaaatgacacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggatacttactgttcacaggacatctcaagtgcaggctgaggatggacaaactacagctcaaaggaatgtcatactctatgtgcacaggaaagtttaaagttgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacagaaaaagatagcccagtcaacatagaagcagaacctccattcggagacagctacatcatcataggagtagagccgggacaattgaagctcaactggtttaagaaaggaagttctatcggccaaatgtttgagacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcacaggagtcattatcacatggataggaatgaattcacgcagcacctcactgtctgtgtcactagtattggtgggagccgtgacgctgtatttgggagttatggtgcaggccgatagtggttgcgttgtgagctggaaaaacaaagaactgaagtgtggcagtgggattttcatcacagacaacgtgcacacatggacagaacaatacaagttccaaccagaatctccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaagagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgctagaaagtgagatgataattccaaagaatttcgctggaccagtgtcacaacacaactacagaccaggctaccatacacaaacagcaggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtccttaaaatggtgagaaaaatggaaaagtatcaattggcagtgactatcatggctatcttgtgcgtcccaaatgcagtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgcggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagtattgaagacaatccagagatcgaagatgacatttttcgaaagagaaaattgaccatcatggacctccacccaggagcgggaaagacgaagagataccttccggccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggtcacaactgacatttcagaaatgggtgccaacttcaaggctgagagggttatagaccccagacgctgcatgaaaccagttatactaacagatggtgaagagcgggtgaccctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgctgcacacggctgaagcaggtggaagggcgtacaatcatgctctcagtgaactgccggagaccctggagacattgcttttactgacacttctggctacagtcacgggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttaagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgtcgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaacacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatctggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagcatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtataacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccttgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagggaccaaagaggtagtggacaagttggtacctatggactcaatactttcaccaatatggaagcccaactaatcagacagatggagggagaaggagttttcaaaagcattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttgggaaaaagagaagaccaatggtgcggctcattgattgggctaacaagcagggtcacctggggcaagaacatccaaacagcaataaatcaagttagatcccttataggcaatgaggaatacacagattacatgccatccatgaaaagattcagaagagaagaggaagaggcaggagtcctgtggtag

SEQ ID NO: 6999 - RNA, 9876 nt, synthetic construct
  misc_feature 1..9876: note = derived and/or modified CDS sequence (wt) from DENV-2__FM210215__SS-prME
  source 1..9876: mol_type = other RNA
tctgcaggcatgatcgttatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcaccggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatacgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgctttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccagccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttacaaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgtcgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaagaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattacaaaatgcatggaaagtgagttgcacaatactggcagtggtgtccgtttccccactgcttttgacatcctcacagcaaaaaacggattggataccattagcattgacaatcaagggtctcaatccaacagccatctttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagaaagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacattgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaatatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaactcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaagcgtaagagaagtgaaaggtctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggctgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctgggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7000 - RNA, 9876 nt, synthetic construct
  misc_feature 1..9876: note = derived and/or modified CDS sequence (wt) from DENV-2__FM210216__SS-prME
  source 1..9876: mol_type = other RNA
tcggcaggcatgatcattatgctgattccaacagtgatggcgttccatctgaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccagggttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgctggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctattggccaaatgtttgagacaacgatgagaggggcgaagagaatggccattttgggtgacacagcctgggactttggatccctgggaggagtgtttacatctataggaaaagctctccaccaagtctttggagcaatttatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacgacagagtgccctaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaaccactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacacgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagttggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggactcccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagtataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcgcactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatttttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgttgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtctttttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgactggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtctatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7001 - RNA, 9876 nt, synthetic construct
  misc_feature 1..9876: note = derived and/or modified CDS sequence (wt) from DENV-2__FM210217__SS-prME
  source 1..9876: mol_type = other RNA
acagcaggcgtgattattatgttaattccaacagcgatggcgttccatttaaccacacgtaatggagaaccacacatgatcgttggcagacaagagaaagggaaaagtcttctgtttaaaacagaggatggtgtgaacatgtgtaccctcatggccattgatcttggtgaattgtgtgaagatacaatcacgtacaagtgccccctcctcaggcagaatgaaccagaagatatagattgttggtgcaactccacgtccacatgggtaacttatgggacgtgtaccaccacaggagatcacagaagagaaaaaagatcagtggcactcgttccacatgtgggtatgggactggagacacgaactgaaacatggatgtcgtcagaaggggcctggaaacacgctcagagaattgaaacctggattttgagacatccaggctttaccataatggcagcaatcctggcatacaccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaactgaagccaaacaacctgccactctaaggaagtactgtatagaggcaaagctgaccaatacaacaacagaatctcgttgcccaacacaaggggaacccagtctaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccattgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggcctcgacttcaatgagatggtgctgctgcagatggaagataaagcttggctggtgcacaggcaatggttcctagacctgccgttaccatggctacccggagcggacacacaaggatcaaattggatacagaaagagacactggtcaccttcaaaaatccccacgcgaagaaacaggatgtcgttgttttaggatctcaagaaggggccatgcacacggcactcacaggggccacagaaatccagatgtcatcaggaaacttattattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccatttggagacagctacatcattataggagtagagccgggacaattgaaactcaactggttcaagaaaggaagttccatcggccaaatgtttgagacaacaatgagaggagcaaagagaatggctattttaggtgacacagcctgggattttggatctctgggaggagtgtttacatctataggaaaggctctccaccaagtttttggagcaatctatggggccgcttttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtaagctggaaaaacaaagaactgaaatgtggcagcgggatcttcatcacagataacgtgcatacgtggacagaacaatacaagttccaaccagaatccccttcaaaattagcttcagctatccaaaaagctcatgaagagggtatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatcccacaaccagacctttctcattgatggccctgaaacagcagagtgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagttaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggacggatgctggtatgggatggaaatcagaccattaaaagagaaagaagagaatttggtcaactccctggtcacagccggacatgggcagattgacaacttttcactaggagtcttgggaatggcactattcctggaagaaatgctcaggacacgagtaggaacgaaacatgcaatactgctagttgcagtttcttttgtgacattgatcactgggaacatgtcctttagagatttgggaagagtaatggttatggtgggcgctgccatgacggatgacataggtataggagtgacttatcttgccctactggcagctttcaaagtaagaccaacttttgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgaccatcatggccatctcgtgtgtcccaaatgcagtgatactgcaaaacgcatggaaggtgagctgcacaatattggcaacggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttgaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctagcattggaacctgggaaaaatccaagagctgtccaaacgaaacctggacttttcaaaaccaacaccggaaccataggcgccgtatctttggacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagttgagatgggtgaggcagctgggattttcatgacagccactcctccgggaagtaaagacccatttcctcagagcaatgcaccgatcatggatgaggaaagagaaatccctgagcgttcgtggaactctggacatgaatgggtcacggattttaaggggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgctgcatgaaaccagttatattaacagatggcgaagagcgggtgatcttggcaggacccatgccagtaacccactctagtgcagcgcaaagaagagggagaatagggagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactatgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactagataacctagctgtgctgcatacggctgaggcaggtggaagggcgtacaatcatgctctcagtgaactgccggagacccttgagacactacttttactgacactcctggctacagtcacgggaggaattttcttattcttaatgagtggaaaaggtgtagggaagatgaccctgggaatgtgctgcataataacggctagcatcctcctatggcatgcacagatacaaccacactggatagcagcttcaataatattggagttttttctcatagttttgctcattccagagccagaaaaacagagaacaccccaagataaccaactgacctacgttgtcatagccatccttacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaactcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggacttcaagcgaaagcaactagagaagctcagaaaagagcagcagcaggcatcatgaaaaacccaacagtcgatggaataacagtgattgacctagatccaataccctatgacccaaaatttgaaaaacagctaggacaagtaatgctcctgattctctgcgtgactcaagtattaatgatgaggactacatgggctttgtgtgaggctctaaccttagcgaccgggcccatctccacattgtgggaaggtaatccagggaggttttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtggaggactaaagaatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcgtcagtgaacatgatctcaaggatgctgattaacagattcacaatgaaacacaagaaagccacctacgagccagatgttgacctagggagcggaacccgcaacattggaattgaaagtgagataccaaatctagacataataggaaagagaatagagaaaataaaacaagagcatgaaacatcatggcactatgaccaggaccacccatacaaaacatgggcttaccatggtagctatgaaacaaaacagactggatcagcatcatccatggtgaacggagtggtcagactgctgacaaaaccttgggacgtcgtccctatggtaacacagatggcaatgacagacacgactccatttggacaacagcgtgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagctttgggggccatattcactgatgagaacaaatggaagtcggcacgcgaggctgttgaagatagtaggttttgggagctggttgacaaggaaagaaatctccatcttgaagggaagtgtgaaacatgtgtgtacaacatgatgggaaagagagaaaagaaactaggggagttcggcaaggcaaaaggtagcagagccatatggtacatgtggcttggagcacgcttcttggagtttgaagccttgggattcttgaatgaggatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggcacctatggccttaacactttcaccaatatggaagcccaactaattagacagatggagggagaaggaattttcaaaagcattcagcacctgacagccacagaagaaatcgctgtgcagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccatttccatgagttaatcatgaaagatggtcgcgtgctcgtagttccatgcagaaaccaagatgaactgatcggcagggcccgaatttcccagggagctgggtggtctctgaaggagacggcctgtttggggaagtcttacgctcaaatgtggagtctgatgtacttccacagacgtgacctcaggctggcggcaaacgccatttgctcggcagtcccgtcacattgggttccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7002 - RNA, 9876 nt, synthetic construct
  misc_feature 1..9876: note = derived and/or modified CDS sequence (wt) from DENV-2__JX286524__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacatccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagctaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatttatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcataatcagacctttcttattgatggccctgaaacagcagaatgccccaacacaaacagagcttggaactcactggaagttgaagactatggttttggagtttttaccaccaatatatggctaaaattgagagaaaaacaggatgtgttttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaagttttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtatgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcttggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcagagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgacggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaactcccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacttacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggattaaagaatgtgagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaattacggctgagtggctttggaaagaactaggaaaggaaaagacacctagaatgtgtaccagagaagaattcacaagaaaagtgagaagcaatgcagccttgggagccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 7003 - RNA, 9876 nt, synthetic construct
  misc_feature 1..9876: note = derived and/or modified CDS sequence (wt) from DENV-2__JX286520__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcattgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaacccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtactggaaagtttaaaatcgtgaaggaaatagcagaaacacaacatggaacaatagttatcagagtacaatatgaaggggacggctctccatgtaagatcccctttgagataacagatttggaaaaaagacacgtcttaggacgcctgattacagttaacccaatcgtaacagaaaaagatagcccagtcaacatagaagcagaacccccattcggagacagttacatcatcgtgggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagccatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggtgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagctatttttttaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattaggacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaatcaagaacaaccaaatactggaagaaaatgtggaagtggaaatctggacaaaagaaggggaaaggaaaaaattaaaacccagatggttggatgctaggatctattctgatccactggcactaaaagaattcaaggaatttgcagctggcagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacttcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctggaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactatgggaaggaaatccagggagattttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgtttttttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctctaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 7004 - RNA, 9876 nt, synthetic construct
  misc_feature 1..9876: note = derived and/or modified CDS sequence (wt) from DENV-2__JX286525__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacatccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcataggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatttatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcataatcagacctttcttattgatggccctgaaacagcagaatgccccaacacaaacagagcttggaactcactggaagttgaagactatggttttggagtttttaccaccaatatatggctaaaattgagagaaaaacaggatgtgttttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaagttttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtatgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcttggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccaatcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcagagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgacggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaactcccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggattaaagaatgtgagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaattacggctgagtggctttggaaagaactaggaaaggaaaagacacctagaatgtgtaccagagaagaattcacaagaaaagtgagaagcaatgctgccttgggagccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggacatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 7005 - RNA, 9876 nt, synthetic construct
  misc_feature 1..9876: note = derived and/or modified CDS sequence (wt) from DENV-2__KM279598__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagctatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatgtggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttagccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgacccaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7006 - RNA, 9876 nt, synthetic construct
  misc_feature 1..9876: note = derived and/or modified CDS sequence (wt) from DENV-2__KM279576__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagctatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagcttagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcctggaagaaaatgtggaagtagaaatttggacaaaagaaggagaaaggaagaaattaaaacccagatggttggatgctaggacctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttagccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgacccaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7007 - RNA, 9876 nt, synthetic construct
  misc_feature 1..9876: note = derived and/or modified CDS sequence (wt) from DENV-2__KC964095__SS-prME
  source 1..9876: mol_type = other RNA
tctgcaggcatgattattatgctgattccaacagtaatggcgttccatctaaccacacgcaacggagaaccacacatgatcgtcagtatacaagagaaagggaaaagtcttctgtttaagactgaggatggcgtgaacatgtgcaccctcatggccatggaccttggtgaattgtgtgaagacacaatcacgtacaagtgtccccttctaaggcagaatgagccagaagacatagaccgttggtgcaattccacgtccacatgggtaacctatgggacttgtaccaccacgggagaacatagaagagaaaaaagatcagtggcacttgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagccctgattttcatcctactgacagctgtcgctcctccaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacggaagccaaacagcctgccaccctaaggaagtactgcatagaagcaaagctaaccaacacaacaacagaatctcgttgtccaacacagggggaacccagcctaaaagaagagcaggataagaggttcgtctgcaaacactccatagtagacagagggtggggaaatggatgtggatcatttggaaagggaggcattgtgacctgtgctatgttcacatgcaagaagaacatggaagggaaaatcgtgcaaccagaaaacttggaatacaccattgtggtaacacctcactcaggggaagagcatgcgatcggaaatgacacaggaaaacatggcaaggaaatcaaagtaacaccacagagttccgtcacagaagcagaattgacaggttatggcaccgtcacgatagagtgctctccgagaacaggcctcgacttcaatgagatggtgttgctgcagatgggaaataaagcttggctggtgcataggcaatggttcctagacctgccgttaccatggctgcccggagcggacacacaagggtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttactcttcaccggacatctcaagtgcgggctgagaatggacaagctacagctcaaaggaatgtcatactccatgtgcacgggaaagttcaaagttgtgaaggaaatagcagaaacacaacatggaacgatagttatcagagtgcaatatgaaggggacggctctccatgtaaaatcccttttgagataatggatttggaaaagagatatgtcttaggccgcctgatcacagtcaacccaattgtgacagaaaaagatagcccagtcaacatagaagcagaacctccattcggtgacagctacatcatcataggagtagagccgggacaactgaagctcaactggttcaagaaaggaagttctatcggccaaatgtttgagacaacaatgaggggggcgaagagaatggccattttgggtgacacagcctgggatttcggatccctgggaggagtgtttacatctataggaaaagctctccaccaagtctttggagcaatctatggagctgccttcagtggggtttcatggactatgaaaatcctcataggagtcattatcacatggataggaatgaactcacgcagcacctcactgtctgtgtcactagtattggtaggaattgtgacactgtacttgggagtcatggtgcaggccgatagtggttgcgttgtgagctggaaaaacaaagaactgaaatgtggcagtgggattttcatcacagacaacgtgcgcacatggacagaacaatacaagttccaaccagaatccccttcaaaactagcttcagctatccagaaagctcaagaagagggaatttgtgggatccgctcagtgacaagattggagaacctaatgtggaaacaaataacaccagaattgaatcacattctagcagaaaatgaggtaaaattaactatcatgacaggagacatcaaaggaaccatgcaggcaggaaaacgatctctgcggcctcagcccactgagctaaagtattcatggaaaacatggggcaaagcaaaaatgctctccacagagtctcataaccaaacctttcttattgatggccccgaaacagcagaatgccccaacacaaatagagcttggaactcgttggaggttgaagactacggttttggaatgttcaccaccaatatatggctacaattgaaagaaaaacaggatgcattctgcgactcaaaactcatgtcagcggccataaaagacaacagagccgtccatgccgacatgggttattggatagaaagtgcactcaatgacacatggaagatagagaaagcttctttcattgaagtaaaaaactgccactggccaaagtcacacaccctctggagtaatggagtgctagaaagtgagatgataattccaaagaatctcgctggaccagtgtctcaacacaactatagaccaggctatcatacacaaatagcaggaccatggcatcaaggtaagcctgagatggactttgatttctgcgatggaaccacagtggtagtgactgaggactgcggaaatagaggaccctctttaagaacaactactgcctctggaaaactcataacagaatggtgctgccgatcttgcacattaccacccctaagatacagaggtgaggatgggtgctggtacgggatggaaatcagaccgttgaaagagaaagaagaaaatttggttaactccttggtcacagccggacatgggcagattgacaatttttcactaggagtcttgggaatggcattgttcctggaggaaatgcttaggacccgagtaggaacgaaacatgcaatactactagttgcagtttcttttgtgacattgatcacagggaacatgtcctttaaagacctaggaagagtggtggttatggtgggcgccaccatgacggatgatataggtatgggcgtaacttatcttgccctactagcagccttcaaagtcagaccgacttttgcagctggactactcttgagaaaactgacctccaaggaattgatgatgactaccataggaattgtactcctctcccaaagcactataccagagaccgttcttgaattgactgatgcgctagccttaggcatgatggccctcaaaatagtaagagacatggaaaagtatcaattagcagtgactatcatggctatcttgtgcgtcccaaacgcagtgatattgcagaatgcatggaaagtgagttgcacaatactagcagtggtatccgtttccccactgcttttgacatcctcacagcaaaaaacggattggataccattagcattgacaatcaagggtctcaatccaacagccatttttctaacaactctctcaagaaccaacaagaaaaggagctggccactaaatgaggctatcatggcagtcggaatggtgagcattttagccagttctctcctaaaaaatgatattcccatgacaggaccactagtggctggagggctcctcactgtgtgctatgtgctcactggacgatcggccgacttggaactggagagagcaactgatgtcaattgggaagatcaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctatgggaagtaaagaaacaacgggccggagtattgtgggatgttccttcacccccacccatgggaaaggctgaactggaagatggagcctacagaatcaagcaaaaaggggttcttgggtattcccagatcggagctggagtttataaagaaggaacattccatacaatgtggcatgtcacacgtggcgccgtcctaatgcataaaggaaagaggattgaaccatcatgggcggacgtcaaaaaagatctaatatcatatggaggaggctggaagctgggaggagaatggaaggaaggagaagaagtccaggtgctggcactggagcctggaaaaaatccaagagccgtccaaacaaaacctggtcttttcaagaccaacactggaacaataggtgccgtatctctggacttttcccctggaacgtcaggatctccaatcattgacaaaaaaggaaaagttgagggtctttatggtaatggtgttgtcacaaggagcggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacattaatcctggcccccactagagttgtggcggctgaaatggaagaagctctcagaggacttccaataagataccaaacccccgccatcagagctgagcacacagggcgggaaattgtggatctaatgtgtcacgccacatttaccatgaggctgctatcaccagttagagtgccaaactacaacctgattatcatggatgaagcccatttcacagacccagcaagtatagcagctagaggatacatctcaactcgagtggagatgggtgaagcagctgggatttttatgacagccactcctccgggaagcagagatccatttcctcagagcaatgcaccaatcatagatgaagaaagagaaatccctgaacgttcatggaattctggacatgagtgggtcacggattttaaagggaagactgtctggttcgttccaagcataaaagcagggaatgatatagcagcttgcctgagaaaaaatggaaagaaagtgatacaacttagtaggaagacttttgattctgagtatgtcaagactagaaccaatgattgggatttcgtggttacaactgacatttcagaaatgggtgccaatttcaaggctgagagggttatagaccccagacgctgcatgaaaccagtcatactaacagatggtgaggagcgggtgattctggcgggaccaatgccagtgacccactctagtgcagcgcaaagaagagggaggataggaagaaatccaaaaaatgaaaatgaccagtacatatacatgggggaacctctggaaaatgatgaagactgtgcacactggaaagaagccaaaatgctcctagataacattaacacaccagaaggaatcattcccagtatgtttgaaccagagcgtgaaaaggtggatgccattgatggcgaataccgcttgagaggagaagcaaggaaaacctttgtggacctaatgagaagaggagacctaccagtctggttggcctacaaagtggcagctgaaggcatcaactatgcagacagaaggtggtgttttgatggaatcaagaacaaccaaatcctggaagagaatgtagaagttgaaatctggacaaaagaaggggaaaggaagaaattgaaacccagatggctggatgctaggatctactctgacccactggcgctaaaagaattcaaagaatttgcagccggaagaaagtctctgaccctgaacctaattacagaaatgggtaggcttccaacattcatgactcagaagactagagacgcactggacaacttagcagtgctgcacacggctgaggcaggtggaagggcgtacaatcatgctctcagtgaactgccggagaccctggagacactgcttttactgacacttctggctacagtcacgggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgctcattccagaaccagaaaaacagagaacaccccaagacaaccaattgacctatgttgtcatagccatcctcacagtggtggccgcaaccatggcaaacgagatgggtttcctagaaaaaacgaagaaagatcttggattaggaagcatcacaacccagcaacccgagagcaacatcctggacatagatctaccccccgcatcagcatggacgctgtatgccgtggctacaacatttgttacaccaatgctgagacatagcattgagaattcctcagtgaatgtatccctaacagccatagccaaccaagcaacagtgttaatgggtctagggaaaggatggccattgtcaaagatggacatcggagttccccttctcgccattggatgctactcacaagtcaatcccataactctcacagcagctcttctcttattggtagcgcattatgccattatagggccaggacttcaagcaaaagcaaccagagaagctcagaaaagagcagcggcgggcatcatgaaaaacccaaccgtcgatggaataacagtgattgatctagatccaataccttatgatccaaagtttgaaaagcagttgggacaagtaatgctcctagtcctctgcgtgactcaagtattgatgatgaggactacatgggctctgtgtgaggccttaaccttagctaccgggcccatctccacactgtgggaaggaaatccaggaaggttctggaacactaccattgcggtgtcaatggctaacatctttagagggagttacttggctggagctggacttctcttttccattatgaagaacacaactaacacaagaaggggaactggcaacataggagagacgcttggagagaaatggaaaagccgattgaacgcactgggaaaaagtgaatttcagatctacaagaaaagtggaatccaggaagtggataggaccttagcaaaagaaggcatcaagagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctgacaaaaggaggaccaggacacgaagaacccatccccatgtcaacatatgggtggaatctagtgcgtcttcaaagtggagttgacgttttcttcatcccgcccgaaaagtgtgacacattgctgtgtgacataggggagtggtcaccaaaccctacagtggaagcaggacgaacactcagagtccttaatttagtagaaaattggttgaacaacaacactcaattttgtataaaagtcctcaacccatatatgccctcagttatagaaaaaatggaaacactgcaaaggaaatatggaggagccttagtgagaaatccactctcacggaactccacacatgagatgtactgggtatccaacgcttccgggaacatagtgtcatcagtgaacatgatttcaaggatgttgatcaacagattcacaatgagacataagaaagccacatacgagccagacgttgacctcggaagcggaacccgcaacatcggaattgaaagtgagacaccaaatttagacataattgggaaaagaataggaaaaataaaacaagagcatgaaacatcatggcactatgaccaagaccacccatacaaaacgtgggcctaccatggcagctacgaaacaaaacagactggatcagcatcatccatggtggacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaagagacacctaggatgtgcaccagagaagaattcacaagaaaggtgagaagcaatgcagccttaggtgccatattcactgatgagaacaagtggaagtcggcacgtgaggctgttgaagatagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctacacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaccaccaagaggcacagtaatggacattatatcgagaagagaccaaagaggtagtggacaagttgtcacctacggcctcaatactttcaccaacatggaagcccaactgatcagacagatggagggagaaggagtttttaaaaatattcagcacctgacagtcacagaagaaatcgccgtgcaaaactggttagcaagagtggggcgcgaaaggttatcaagaatggccatcagtggagatgattgtgttgtgaaacctttagatgacagattcgcaagcgctttgacagctctaaatgacgtgggaaagattagaaaagacatacaacaatgggaaccttcaagaggatgggacgattggacacaagtgcccttctgctcacaccattcccatgagctaatcatgaaggatggtcgtgtacttgttgttccatgcagaaaccaggatgaactgattggcagagcccgaatctcccaaggagcagggtggtctttgcgggagacggcttgtttggggaagtcttacgcccaaatgtggagcttgatgtatttccacagacgcgacctcaggttggcggcaaatgccatttgctccgcagtgccatcacattgggttccaacaagccgaacaacctggtctatacacgccaaacatgaatggatgacaacggaagacatgctgacagtctggaatagggtgtggattcaggaaaacccatggatggaagacaaaaccccagtggaatcatgggaggaaatcccatacttggggaaaagagaaggccaatggtgtggctcgttgattgggttaacaagcagggccacatgggcaaagaacatccaaacagcaataaatcaagttagatctcttataggcaatgaggaatacacagattacatgccatccatgaaaagattcagaagagaagaggaagaagcaggagtcctgtggtag

SEQ ID NO: 7008 - RNA, 9876 nt, synthetic construct
  misc_feature 1..9876: note = derived and/or modified CDS sequence (wt) from DENV-2__KC964094__SS-prME
  source 1..9876: mol_type = other RNA
tctgcaggcatgattattatgctgattccaacagtaatggcgttccatctaaccacacgcaacggagaaccacacatgatcgtcagtatacaagagaaagggaaaagtcttctgtttaagactgaggatggcgtgaacatgtgcaccctcatggccatggaccttggtgaattgtgtgaagacacaatcacgtacaagtgtccccttctaaggcagaatgagccagaagacatagactgttggtgcaattccacgtccacatgggtaacctatgggacttgtaccaccacgggagaacatagaagagaaaaaagatcagtggcacttgttccacatgtgggaatgggactggagacgcgaaccgaaacatggatgtcatcagaaggagcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgtagtataggaatatcaaatagagactttgtggaaggggtttcaggaggaagctgggttgacgtagtcttagaacatggaagctgtgtgacgacgatggcgaaaaataaaccaacattggattttgaactgacaaaaacggaagccaaacatcccgccactttaaggaaatattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccgtcacagaagcagaactaacaggctatggcactgtcacgatggaatgctctccgagaacgggcctcgacttcaatgagatggtgttgctgcaaatgaaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttactgttcacaggacatcttaagtgcaggctgagaacggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgttacagaaaaagacagcccagtcaacatagaagcagaacctccattcggagacagctacatcattataggagtagaaccgggacaactgaagctcagctggtttaagaaagaaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagtacctcactgtctgtgtcactagtattagtgggggtcgtgacattgtatttgggagttatggtgcaggccgatagtggttgcgttgtgagttggaaaaacaaagaactgaaatgtggcagtgggatttttgtcacagacaacgtgcacacatggacagaacaatacaaattccaaccagaatccccttcaaagctggcttcagctatccagaaggctcatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaacgtcccaacacaaacagagcttggaactcactagaagttgaagactatggctttggagtattcaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgttagaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtactcctctctcagagcaccataccagagaccatacttgaactgactgacgcgttggctctggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcgctggaagatcggctgatttggaactggagagagctgctgacgtaagatgggaagaacaggcagagatatcaggaagtagcccaattctgtcaataacaatatcggaagatggtggcatgtcgataaaaaatgaagaagaagaacaaacactgactatactcattagaacaggactgctggtgatatcaggactctttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcacgtcacacgtggtgctgtcctaatgcataaagggaagagaattgaaccatcatgggcggacgtcaagaaagacctaatatcgtatggaggaggctggaagctagaaggagaatggaaggaaggagaagaaatccaggtcctggcattagagcctggaaagaatccaagagccgtccaaacaaaacccggtctttttaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagatcgaagatgacacctttcgaaagaaaagattgaccatcatggacctccacccaggagcgggaaaaacaaagagataccttccagcaatagtcagagaagccataaaacgaggcttgagaacactaatcctggcccccactagagttgtagcggctgaaatggaagaagctctcagaggacttccaataaggtaccaaaccccagctatcagagctgagcacactgggcgggagattgtggatctaatgtgtcacgccacatttaccatgaggctgctatcaccaattagagtgccaaattacaacctgatcatcatggatgaagcccatttcacagacccagcaagcatagcagctagaggatacatttcaactcgagtagagatgggtgaagcagctgggattttcatgacagctactcctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaggaaagtgatacaactcagcaggaagacctccgattctgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttgagaggagaagcgaggaaaacttttgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcctgcatacggctgaagcaggcggaagggcgtacaatcatgctcttagtgaactgccggagaccctggagacattgcttttactgacacttttggccacagtcacgggcggaatcttcctgttcttgatgagcggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattgcaacgcagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccctagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggttctcaacccatatatgccctcagttatagaaaaaatggaagcgctacaaaggaaatacggaggagctttggtggggaatccactctcacgaaattccacacacgagatgtactgggcatccaatgcttccgggaatatagtgtcatcagtgaacatgatttcaagaatgttgattaacagattcacaatgagacataagaaggccacatacgagccagacgttgacctcggaagcggaacccgccacatcggaattgaaagtgagacaccaaatttagacataattgggaaaagaatagaaaaaataaaacaagagcatgaaacatcatggcactgtgaccaagaccacccatacaaaacgtgggcctaccatggcagctacgaagcaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaaggcacctaggatgtgcaccagagaagaattcacaagaaaggtgagaagcaatgcagccttaggtgccatgttcactgatgagaacaagtggaagtcggcacgtgaggctgttgaagatagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctacacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggctagtaagagtggggcgtgagaggttatcaagaatggccatcagtggagatgattgtgttgtgaaacccttagatgacaggtttgcaagcgctctaacagctctaaatgacatgggaaaggtcaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagattacatgccatccatgaaaagattcagaagagaagaggaagaagcaggagtcctgtggtag

SEQ ID NO: 7009 - RNA, 9876 nt, synthetic construct
  misc_feature 1..9876: note = derived and/or modified CDS sequence (wt) from DENV-2__KC964093__SS-prME
  source 1..9876: mol_type = other RNA
actgcaggtgtgatcatcatgatgattccaacagtggtggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaagagatcagtggcactcgttccacatgtgggaatgggactggagacacgaactgaaacatggatgtcatcagaaggagcctggaaacatgctcagagaatcgaaacttgggtcttgagacatccaggctttaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgacaaaaacggaagccaaacatcccgccactttaaggaagtattgtatagaggcaaagctgaccaacacaacaacagcatctcgctgcccaacacaaggagaacccagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgtagtcggaaatgacacaggaaaacacggcaaggaaattaaagtaacaccacagagttccattacagaagcagaactgacaggctatggcactgtcacgatggaatgctctccgagaacgggcctcgactttaatgagatggtgttgctgcaaatggaagacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggccacggaaatccagatgtcatcaggaaacttattgttcacaggacatcttaagtgcaggctgagaatggacaaactacagctcaaaggaatgtcatattctatgtgtacaggaaagtttaaagctgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagttacatcattataggagtagaaccgggacaactgaagctcagctggtttaagaaaggaagctctattggccaaatgtttgagacaacaatgagaggagcgaagagaatggccattttaggtgacacagcttgggattttggatccctgggaggagtgttcacatctataggaaaagccctccaccaagtctttggagcaatctatggggctgcctttagcggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgtgagttggaaaaacaaagaactgaaatgtggtagtgggatttttatcacagacaacgtgcacacatggacagaacaatacaaattccagccagaatccccttcaaagctggcttcagcaatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaggcgaaaatgctctccacagagcttcataaccacacctttctcattgatggccccgaaacagcagaatgtcccaacacaaacagagcttggaactcactagaagttgaagactatggctttggagtatttaccaccaacatatggctgaaactgaaagaaaggcaggatgtattttgtgactcaaaactcatgtcagcagccataaaagacaacagggccgtccacgccgatatgggttattggatagaaagcgcacttaatgacacatggaagattgagaaagcctcttttattgaagttaaaagctgccactggccaaagtcacacactctctggagtaatggagtgctagaaagtgagatgataattccaaagaattttgcaggaccagtgtcacagcacaactacagaccaggctatcatacacaaacggcaggaccctggcatctaggtaagcttgagatggactttgatttttgtgaaggaaccacagtggtagtgactgaggactgtggaaatagaggaccctctttaagaacaactactgcttctggaaagctcataacagaatggtgctgccggtcttgcacattaccaccgctaaggtacagaggtgaggatggatgctggtatggaatggaaatcaggccattgaaagagaaagaagagaacctggtcaactctttggtcacagccggacatggacagattgacaacttctcactaggagtcttgggaatggcattgttcctggaagaaatgctcaggacccgcgtaggaacgaaacatgcaatattgctagttgcagtttctttcgtgacattgatcacagggaacatgtcttctcgagatttggggagagtgatggttatggtgggcgccactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcagcataccagagaccatacttgaactgactgacgcgttggctctggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcgctggaagatcggctgatttggaactggagagagctgctgacgtaagatgggaagaacaggcagagatatcaggaagtagcccaattctgtcaataacaatatcggaagatggtggcatgtcgataaaaaatgaagaagaagaacaaacactgactatactcattagaacaggactgctggtgatatcaggactctttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcacgtcacacgtggtgctgtcctaatgcataaagggaagagaattgaaccatcatgggcggacgtcaagaaagacctaatatcgtatggaggaggctggaagctagaaggagaatggaaggaaggagaagaaatccaggtcctggcattagagcctggaaagaatccaagagccgtccaaacaaaacccggtctttttaaaactaacactggaaccataggcgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcattgaagacaatccagagattgaagatgacatctttcgaaagaaaagattgaccatcatggacctccacccaggggcgggaaaaacgaagagataccttccagcaatagtcagagaagccataaaacgaggcttgaggacattaatcctggcccccactagagttgtggcggctgaaatggaagaagctctcagaggacttccaataagataccaaacccccgccatcagagctgagcacactgggcgggagattgtggatctaatgtgtcacgccacatttaccatgaggctgctatccccaattagagtaccaaattacaacctgatcatcatggatgaagcccatttcacagacccagcaagcatagcagctagaggatacatttcaactcgagttgagatgggtgaagcagctgggatttttatgacagctactcctcctggaagcagagacccatttcctcagagcaatgcaccaatcatggatgaagaaagggaaatccctgagcgctcgtggaattctggacatgaatgggttacggattttaaagggaagactgtttggtttgttccaagtataaaagcaggaaatgatatagcagcttgcctgagaaagaatggaaagaaagtgatacaactcagcaggaagacctttgattctgaatatgtcaagactaggaccaatgattgggactttgtggtcacgacagacatttcagaaatgggcgctaacttcaaggctgagagggttatagaccccaggcgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagtatgttcgaaccagagcgtgaaagggtggatgccattgatggtgaataccgcttaagaggagaagcgaggaaaacttttgtggacctaatgagaagaggagacctaccagtctggctagcctatagagtggcagctgaaggtatcaactacgcagacagaagatggtgctttgatggagtcaagaacaatcagatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctcaccctgaatctaatcacagagatgggtaggctcccaaccttcatgactcagaaagcaaggaacgcactagacgacttagcagtcctgcatacggctgaggcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgccatagccatccttacagtggtggccgcaaccatggcaaacgagatgggtttcctggaaaagacaaagaaagacttcggattgggaagcattgcaacccagcagcctgagagcaacatcctggacttagatctacgtcctgcatcagcttggactctatatgctgtggcaacaactttcatcacaccaatgctgagacacagcattgaaaattcctcagtgaatgtgtctctaacggccattgccaaccaagccacagttttaatgggtcttgggaaaggatggccattgtcaaaaatggacatcggagttccccttctcgctatcgggtgctattcacaagttaaccccataactctcacggcagcccttctcttattggtagcacattatgccatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctttaaccttagcgactgggcccatctccacactgtgggaaggaaatccagggagattttggaatacaactatcgcagtatcaatggctaacatttttagagggagctacctggccggagtcggacttctcttttctatcatgaagaatacggccaacacaagaaggggaactggcaacacaggagagacgcttggagaaaaatggaaaaaccgattgaatgcattggggaagagtgaattccagatctacaagaaaagtggaatccaggaggtggatagaaccttagcaaaagaaggcatcaaaagaggagaaacggaccatcacgctgtgtcgcgaggctcggcgaaactgagatggttcgtcgagagaaacctggtcacaccagaagggaaagtaatggacctcggttgcggcagggggggctggtcatactattgtgggggactaaagaatgtaaaagaagtcaaaggcctaacaaaaggaggaccaggacacgaagaacccattcccatgtcaacatatggttggaacctggtgcgtcttcaaagtggagttgatgttttttttgctccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaacgcttccgggaacatagtgtcatcagtgaacatgatttcaagaatgttgattaacagattcacaatgagacataagaaggccacatacgagccagatgttgacctcggaagcggaacccgtaacatcggaattgaaagtgagataccaaatttggacataattgggaaaagaatagaaaaaataaaacaagagcatgaaacatcatggcactatgaccaagaccacccatacaaaacgtgggcctaccatggcagctacgaaacaaaacagactggatcggcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagaagtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcacctgacagtcacagaagaaattgcagtgaaaaactggttaacaagagtggggcgtgagaggttatcaagaatggctatcagtggagatgattgtgttgtgaaacccctagatgataggtttgcaagcgctctaacagctctaaatgacatgggaaaagttaggaaagacatacaacaatgggaaccttcaagaggatggaacgattggacacaagtgcccttttgttcacaccatttccatgagttaatcatgaaggacgggcgtgtactcgtagttccatgcagaaaccaagatgaactgattggtagggcccgaatctcccagggagccgggtggtctttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacatgccacacatgagtggatgacaacagaagatatgctgacagtctggaacagggtgtggattcaagaaaacccatggatggaagacaaaactccagtagaatcatgggaggaaatcccatatttggggaaaagagaagaccaatggtgcggctcattgatcgggctaacaagcagggccacttgggcaaagaacatccaaacagcaataaatcaagttaggtccttaataggcaatgaggaatacacagactacatgccatccatgaaaaggttcagaagagaagagggagaggcaggagtcttgtggtag

SEQ ID NO: 7010 - RNA, 9876 nt, synthetic construct
  misc_feature 1..9876: note = derived and/or modified CDS sequence (wt) from DENV-2__DQ448231__SS-prME
  source 1..9876: mol_type = other RNA
actgcaggcgtgatcatcatgctgattccaacagcgatggcgttccatttaaccacacgcaacggagaaccacacatgatcgtcagcagacaagagaaagggaaaagtctcttgtttaaaacagaggatggtgtgaacatgtgtaccctcatggccatggaccttggtgaactgtgtgaagacacaatcacttataactgtcctcttctcaggcagaatgaaccagaagacatagattgttggtgtaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcatcgtaacctgtgctatgttcacatgcaaaaaaaacatggaaggaaaaattgtgcagccagaaaacctggaatacaccattgtggtaacacctcattcaggggaagagaacacagttggaaatgacacaggaaaacatggcaaggaaatcaaagtaacaccacagagttccattacagaagcagaactgacaggctacggcactgtcacgatggagtgctctccaagaacgggcctcgacttcaatgagatggtgttgctgcaaatggaaaataaggcttggctggtgcacaggcaatggttcttagacctgccgttaccatggttgcccggagcggacacacaaggatcaaattggatacagaaggagacgttggtcaccttcaaaaatccccatgcgaagaaacaggatgttgttgttttaggatcccaagaaggggctatgcatacagcacttacaggggccacggaaatccagatgtcgtcaggaaacctactgttcacaggacatctcaagtgcaggctgagaatggacaaattacagcttaaaggaatgtcatactctatgtgtacaggaaagtttaaagttgtaaaggaaatagcagaaacacaacatggaacaatagttgtcagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacctccattcggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtctttggagcaatctatggggctgccttcagtggggtctcatggactatgaaaatcctcataggagttgtcatcacatggataggaatgaattcacgtagcacctcactgtctgtgtcactagtattagtgggagtcgtgacattgtatttgggagttatggtgcaggctgatagtggttgtgttgtgagttggaaaaacaaagaactgaaatgtggcagtgggatttttatcacagacaatgtacacacatggacagaacaatacaaattccaaccagaatccccctcaaagctggcttcagctatccagaaagctcatgaagagggcatttgtggaatccgctcagtaacaagactggagaatctaatgtggaaacaaataacaccagaactgaatcacattctatcagaaaatgaggtaaagttgactatcatgacaggagacatcaaaggaatcatgcaggcaggaaaacgatccctgcggcctcagcccactgagctgaagtattcatggaaaacgtggggcaaagcgaaaatactctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgattcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaatggagtgctagaaagtgagatgataattccaaagaattttgctggaccagtatcacaacataattatagaccaggctatcacacacaaacggcaggaccctggcatctaggcaagcttgagatggactttgatttttgcgaaggaaccacagtggtggtgactgaggactgtggaaatagaggaccctctctaagaacaactaccgcttctggaaaactcataacagaatggtgctgccgatcctgcacattaccaccactaagatacagaggtgaggatggatgctggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactagttgcagtttctttcatgacattgatcacagggaacatgtctttccgagacctggggagagtgatggttatggtgggggctgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccataccagagactatacttgaactgactgatgcgttggccttgggcatgatgattctcaagatagtgagaaatatggaaaagtatcaattagcagtgactatcatggctatcttatgtgttccaaatgcagtgatattacaaaatgcatggaaagtgagctgcacaatactggcagtggtgtccgtatccccactgctcttaacatcttcacagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagccagttctctcttgaagaatgacattcccatgacaggaccattagtggctggagggcttctcactgtgtgttacgtgctcactggaagatcggccgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattagaacaggattgctggtgatatcaggactttttcccgtatcaataccaatcacggcagcagcatggtacctgtgggaagtgaagaaacaacgggctggagtattgtgggatgttccttcacccccacctgtgggaaaggccgaactggaagatggagcttatagaatcaagcagaaagggattcttggatactcccagatcggagctggagtttacaaagaaggaacattccacacaatgtggcacgtcacacgtggtgctgttctaatgcataaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaaaactaacaccggaaccataggcgctgtgtctctagacttttctcctggaacgtcaggatctccaatcgtcgacaaaaaaggaaaagtcgtgggtctctatggcaatggtgtcgtcacaaggagtggaacatatgtgagtgccatagcccagactgaaaaaagcattgaagacaatccagagattgaagatgatatctttcgaaaaaaaagattgaccattatggacctccacccaggagcgggaaagacgaaaagataccttccagcaatagtcagagaggccataaaacgaggcttaagaacattaatcctggcccccactagagtcgtggcagctgaaatggaagaagctcttagaggacttccaataagataccaaaccccagccattagagctgagcacactgggcgagaaatcgtggatttgatgtgtcatgccacatttaccatgaggctgttatcaccagttagagtaccaaattacaacttgatcattatggatgaagcccatttcacagacccagcaagcatagcagctaggggatacatttcaactcgagtagagatgggtgaagcagctgggattttcatgacagccactcctccgggaagcagagacccatttcctcaaagcaatgcaccaatcatggatgaagaaagggaaatccctgaacgttcgtggaactctggacatgagtgggttacagattttaaagggaagactgtttggtttgttccgagtataaaagcaggaaatgatatagcagcttgcctgagaaaaaatggaaagaaagtgatacaactcagtaggaagacctttgattctgaatacatcaagactaggaccaatgattgggactttgtggtcacgactgacatttcagaaatgggtgctaacttcaaggctgaaagggttatagaccccaggcgctgcatgaaaccagtcatactaacagacggtgaagagcgggtgatcctggcaggacccatgccagtgacccactctagtgcagcacaaagaagagggagaataggaagaaatccaaagaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgccattgacggtgaataccgcttaagaggagaagcgaggaaaacctttgtggacctaatgagaagaggagacctaccagtctggctggcctacagagtggcagccgaaggcattaactatgcagacagaaggtggtgttttgatggaatcaagaacaaccaaatcttggaagagaatgtggaagtggaaatctggacaaaagagggggaaaggaagaaactgaaacccagatggttggatgctaggatctactctgacccactggcgctcaaagaattcaaagagtttgcagctggaagaaaatccctgaccctgaatttaatcacagaaatgggcaggcttccaacttttatgactcagaaagcaaggaacgcactggacaacttagcagtcctgcatacggctgaagcaggcggaagggcgtacaatcatgccctcagtgaactgccagagaccctggagacattgcttttgctgacacttttggccacagtcacgggcggaatctttttattcttgatgagtggaaaaggtatagggaaaatgaccctgggaatgtgctgcataatcacggccagtattctcctatggtacgcacaaatacaaccacactggatagcagcttcaataatactggagttttttctcatagtcttgctcattccagagccagaaaagcaaagaacaccccaagataaccaattgacttacgttgtcatagccatcctcacagtggtggccgcaaccatggcaaacgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaatgtgtctttaacagccattgccaatcaagccacagtgctaatgggtcttgggaagggatggccattgtcaaaaatggacattggagttccccttctcgccatcgggtgctattcacaagtcaatcccataaccctcacagcagcccttcttttattggtagcacattatgctatcatagggccagggctccaagcgaaagcaaccagagaagcgcagaaaagagcagcagcaggcattatgaaaaacccaactgtggatggaataacagtgattgacctagatccaataccctatgatccaaaatttgagaagcagctgggacaagtaatgctcctagtcctctgcgtgactcaagtactgatgatgaggactacatgggctttgtgtgaggctctaactttagcgaccgggcccatctccacattgtgggaaggaaatccagggagattttggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatctacaagagaagcggaatccaggaagtggatagaaccttggcaaaagaaggcattaaaagaggagaaacggaccatcacgctgtgtcgcgaggctcagcaaagctgagatggttcgtcgagagaaacctggtcacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactccgccagaaaagtgtgacacattgttgtgtgacataggggagtcgtcaccaaatcccacggttgaagcaggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatccactctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaattgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgttgacaaaaccttgggacgtcatccctatggtgacacagatggcaatgacagacacgaccccatttggacaacagcgcgttttcaaagagaaagtggacacgagaacccaagaaccgaaagaaggcacgaagaaactaatgaaaatcacggccgaatggctctggaaagaactaggaaagaaaaagacacctagaatgtgcactagagaagaattcacaagaaaggtgagaagcaatgcagccctaggtgccatattcactgatgagaacaagtggaagtcggcacgtgaggctgttgaagacagtagattttgggaactggttgataaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggattcctgaatgaagatcactggttttccagagagaactctctgagcggagtggaaggagaagggctgcataagctgggttacattctaagagaagtgagcaagaaagaaggaggagcaatgtacgccgacgacacagcaggatgggacacaagaatcacactagaggacttaaaaaatgaagaaatggtgacaaaccacatggaaggagaacacaagaaacttgctgaggccattttcaaattaacgtaccaaaacaaggtggtgcgtgtgcaaagacccacaccaagaggcacagtaatggatattatatcgagaagagaccagagaggtagtggacaagttggcacctatggcctcaacacctttaccaatatgggagcacaactaatcagacagatggagggagaaggagtctttaaaggcatccaacatctgacagccacagaagaagtagcagtgcaagactggttagcaagagtggggcgtgagaggttatcaagaatggccatcagtggagatgactgtgttgtgaaacccttagatgacaggtttgcaagcgctttaacagctctaaatgacatgggaaagattaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcggcaaacgctatttgctcggcagtcccatcacattgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagggccacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 7011 - RNA, 9876 nt, synthetic construct
  misc_feature 1..9876: note = derived and/or modified CDS sequence (wt) from DENV-2__JX470186__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagattgctggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacgtgggtcttgagacatccaggcttcaccataatggcagcaatcctggcttacaccataggaacgacatacttccaaagagtcctgatcttcatcttactgacagctgtcgctccttcaatgacaatgcgttgtataggaatatcaaatagagactttgtggaaggggtatcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccatcgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggcgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgtaggctgagaatggacaaattacaactcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaatcgtcacagagaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttaggaggggtgttcacatccataggaaaggccctccaccaagtctttggagcaatttatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactagagaatctgatgtggaaacaaataacaccagaactgaatcacattttatcagaaaatgaggtaaagttgactatcatgacaggagacattaaaggaatcatgcaggcaggaaaacgatccctacggcctcaacccactgagttgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtatttaccaccaacatatggctgaaaatgaaagaaaggcaggatgtattttgtgactcaaaactcatgtcagcagccataaaagacagcagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccctctttaagaacaactactgcttctggaaaactcataacagagtggtgttgccgatcttgcacactaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattattagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtgctcctctcccaggccaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactaacaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtggtatcaggactctttcccgtgtcaacaccaatcacggcagctgcatggtacctgtgggaagtgaaaaaacaacgagcaggagtattgtgggatgtcccttcacccccacctgtgggaaaggccgaactggaggatggagcctacagaatcaagcagaaagggattctaggatactcgcagatcggagctggagtttacaaagaaggaacatttcacacaatgtggcatgtcacacgtggtgctgttctaatgcataaagggaagagaattgaaccatcatgggcggacgtcaagaaagatctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggtgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccatccaggagcaggaaaaacaaagagataccttccagcaatagtcagagaagccataaaacgaggcttgagaacactaatcctggcccccactagagtggtggcggctgaaatggaagaagctctcagaggacttccaataagataccaaaccccagctatcagagctgagcacactgggcgggagattgtggatctaatgtgtcacgccacatttaccatgaggctgctatcaccaattagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcagggaatgacatagcagcttgcctgagaaagaatggaaagaaagtgatacaactcagcaggaagacttttgactctgaatatatcaagactaggaccaatgattgggactttgtggtcacgacagacatttcagagatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagccaaaatgcttctagacaacatcaacacgcctgaaggaatcattcccagcatgttcgaaccagagcgcgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggagttcgcagctggaagaaagtccctgaccctgaatctaatcacagagatgggtaggctcccaaccttcatgacccagaaagcaaggaatgcactggataacttagcagtcttgcatacagctgaagcaggcggaagggcgtacaatcatgctcttagtgaactgccggagactctggagacattgcttttactgacactcttggccacagtcacgggcggaatcttcctgttcttgatgagcggaaaaggtatagggaagatgaccttgggaatgtgctgcataattacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagaacaacatcctggacatagatctacgtcctgcatcagcttggactctatatgccgtggcaacaactttcatcacaccaatgttgagacatagcattgaaaattcctcagtgaatgtgtctctaacagctattgccaaccaagccacggtgttaatgggtcttgggaaaggatggccattatcaaaaatggacatcggagttccccttctcgctatcgggtgctattcacaagtcaaccccataactctcacagcagcccttctcctattggtagcacattatgctatcatagggccaggactccaagcgaaagcaactagagaagctcagaaaagagcagcagcgggcatcatgaaaaacccaactgtggatggaataacagtgattgacctagatccaataccctatgacccaaagtttgaaaagcagttgggacaagtaatgctcttagtcctctgcgtgactcaagtattgatgatgaggaccacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacgggagagacgcttggagagaaatggaaaaaccggttgaatgcattgggaaagagtgaattccagatctataagaaaagtggaatccaggaagtggatagaaccttagcaaaagaaggcatcaaaagaggagaaacggaccatcatgctgtgtcgcgaggctcggcgaaactgagatggttcgtcgagagaaacctggtcacaccagaagggaaagtagtggaccttggttgtggcaggggaggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccactgttgaagcaggacgaacactcagagttctaaacctagtggaaaattggctgaacaataacacccaattttgcataaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaatatgatttcaagaatgttgatcaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgcgttttcaaagagaaagtggacacgagaacccaagaaccgaaagaaggcacgaaaaaactaatgaagatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagcggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggatttttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaactaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagttacagaagaaattgcagtgaaaaactggttagtaagagtggggcgtgagaggttatcaagaatggccattagtggagatgactgtgttgtgaaacccttagatgacaggtttgcaagcgctctaacagctctaaatgacatgggaaaggttaggaaagacatacaacaatgggaaccttcaagaggatggaacgactggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacgcatgagtggatgacaacagaagacatgctgacagtctggaacagggtgtggatccaagaaaacccatggatggaagacaaaactccagtggagtcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 7012 - RNA, 9876 nt, synthetic construct
  misc_feature 1..9876: note = derived and/or modified CDS sequence (wt) from DENV-2__KU517846__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgccctcttctcaggcagaatgaaccagaagacatagactgttggtgcaactctacgtctacatgggtaacttatgggacatgcaccgccacaggagaacacagaagggaaaaaagatcagtggcactcgttccgcatgtgggaatgggactggagacacgaactgaaacatggatgtcatcagaaggggcctggaaacatgcgcagagaattgaaacttgggtcttgagacacccaggcttcaccataatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacactggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagatagaggatggggaaatggatgcggattatttggaaagggaggtatcgtgacctgtgcaatgttcacatgtaaaaagaacatggaaggaaaaatcgtgcaaccagaaaatttggagtacaccatcgtgataacacctcactcaggggaagagaatgcagtcggaaatgacacaggaaaacacggcaaggaaattaaagtgacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaagagacattggtcactttcaaaaatccccatgcaaagaaacaggatgttgttgttttaggatcccaagaaggggctatgcacacagcactcacaggggccacggagatccagatgtcatcaggaaacttactgttcacaggacatcttaaatgcaggttgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccgattgtcacagaaaaagacagcccagtcaatatagaagcagaacctccattcggagatagctacatcattataggagtagaaccgggacaactgaagctcagctggttcaagaaaggaagttctattggccaaatgtttgagacaacaatgcgaggagcaaagagaatggccattttaggtgacacagcttgggattttggatccctgggaggagtgttcacatctataggaaaggccctccaccaagtctttggagcaatctatggggctgccttcagtggggtttcatggactatgaaaattctcataggagttgtcatcacatggataggaatgaattcacgcagcacctcactgtctgtgtcactagtattagtgggaatcgtgacattgtatttgggagttatggtgcaggctgatagtggttgtgttgtgagttggaaaaacaaagaactgaaatgtggcagcgggatcttcatcacagacaacgtgcacacatggacagaacaatacaaattccaaccagaatccccttcaaaactggcctcagctatccagaaggcccatgaagagggcatttgtgggatccgctcagtaacaagactggagaacctgatgtggaaacaaataacaccagaactgaatcacattctatcagaaaatgaggtaaagttgactatcatgacaggagacattaaaggaattatgcaggcaggaaaacgatccctgcggcctcaacccactgagctgaagtactcttggaaagcatggggcaaagcgaaaatgctctccacagagcttcacaaccacacctttctcattgatggccccgaaacagcagaatgtcccaacacaaacagagcttggaattcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagtgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattatagaccaggctatcatacacaaacggcaggaccctggcacctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccactaaggtatagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattattagttgcagtctctttcatgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagacaatacttgaactgactgatgcgttggctttggggatgatggttctcaaaatagtaagaaacatggaaaagtatcaactagcagtgactatcatggctatcctgtgcgtcccaaacgcagtgatattacaaaacgcatggaaagtgagctgcacgatactggcagtggtatccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcagctgatttggaactggaaagagctgctgacgtaagatgggaggaacaggcagagatatcagggagcagtccaattctgtcgataacaatatcggaagatggcagtatgtcgataaaaaatgaagaagaagaactaacactgaccatacttattagaacaggactgctggtgatatcaggactttttcccgtgtcaataccaatcacggcagctgcatggtacctgtgggaagtgaaaaaacaacgagccggagtattgtgggatgtcccttcacctccacccgtgggaaaggccgaactggaagacggagcctatagaatcaagcagaaagggattttaggatactcgcagatcggagccggagtttacaaagaaggaacattccacacaatgtggcatgtcacacgtggtgctgttctaatgcacaaagggaagaggattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacctggtctttttaaaactaacactggaaccataggcgccgtatctctggacttttctcctggaacgtcaggatctccaattgtcgacaaaaaaggaaaagttgtgggcctttatggcaacggtgtcgtcacaaggagtggaacatatgtgagcgccatagcccagactgaaaaaagcatcgaagacaatccagagattgaagatgacatctttcgaaagaaaagattgaccatcatggatctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagccaagatgcttctagataacatcaacacgcctgaaggaatcattcccagcatgttcgaaccagagcgtgagaaggtggatgccattgatggtgaataccgcctgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctgaccttgaatctaatcaccgagatgggtaggctcccaaccttcatgacccagaaagcaaggaatgcattggacaacttagcagtcctgcatacggctgaagcaggcggaagggcgtacaatcatgctcttagtgaactgccggagactctggagacattgcttttactgacacttttggccacagtcacgggtggaatcttcctgttcttgatgagcggaaagggaatagggaagatgaccctgggaatgtgctgcataatcacggccagtattctcctatggtatgcacaaatacagccacactggatagcagcttcaataatactggagttttttcttatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattaggaagcattacaacccagcaacctgagagcaacatcctggacatagatctacgtcctgcatcagcttggactctatatgccgtggcaacaactttcatcacaccaatgttgagacacagcattgaaaattcctcagtgaatgtatctctaacagccattgccaaccaggccacagtgttaatgggtcttgggaaaggatggccattgtcaaaaatggacatcggagttccccttctcgctatcggatgctattcacaagtcaaccccataactctcacagcggcccttctcttattggtagcacactatgctatcatagggccaggactccaagcgaaagcaactagagaggctcagaaaagagcagcagcgggcatcatgaaaaacccaactgtggatggaataacagtgattgacctagatccaataccttatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggaggttttggaatacaactattgcagtgtcaatggctaacatttttagagggagttacctggccggagccggacttctcttttctatcatgaagaacacggccaacacaagaaggggaactggcaacacaggagagacgcttggagagaagtggaaaaaccggttgaatgcattggggaagagtgaattccagatctataagaaaagtggaatccaggaagtagatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaagggggaccaggacatgaagagcccattcccatgtcaacatatggttggaatctggtgcgtcttcaaagtggagttgatgtcttttttactccgccagaaaagtgtgacacattgctgtgtgacataggggagtcgtcaccaaaccccacggttgaggcaggacgaacactcagagttctaaacctagtggaaaactggctgaacaacaacacccaattttgcataaaggttctcagcccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaagccacatacgagccagatgttgatctcggaagtggaacccgcaacatcggaattgaaagtgagacaccaaatttagacataattgggaaaagaatagaaaaaataaaacaagagcatgagacatcatggcactatgaccaggaccacccatacaaaacgtgggcctaccatggcagctatgaaacaaaacagactggatcagcatcatccatggtgaacggagtggttaggctgctaacaaaaccttgggacgtcatccctatggtgacacagatggcaatgacagacacgactccatttggacaacagcgcgttttcaaagaaaaagtggacacgagaacccaagaaccgaaagaaggtacgaaaaaactaatgaaaatcacggcagaatggctctggaaagaactaggaaagaaaaagacacctaggatgtgcaccagagaagaattcacaagaaaggtgagaagcaatgcagccttaggagccatattcactgatgagaacaagtggaagtcggcacgtgaggctgttgaagacagtggattttgggaattggttgacaaggaaaggaatctccatcttgaaggaaagtgtgagacatgtgtgtacaacatgatgggaaagagagagaagaaactaggggagttcggcaaagcaaaaggcagcagagcaatatggtacatgtggcttggagcacgcttcttagagtttgaagccctaggatttttgaatgaagaccactggttttccagagagaactccctgagtggagtggaaggagaagggctgcacaaactaggctacattttaagagacgtgagtaagaaagagggaggagcaatgtacgccgatgacaccgcaggatgggacacaagaatcacactagaggacttaaaaaatgaagagatggtgacaaaccacatggaaggagaacacaagaaacttgctgaagccattttcagattaacgtaccaaaacaaggtggtgcgtgtgcaaagaccgacaccaagaggcacagtaatggacatcatatcgagaagagaccaaagaggtagtggacaagttgtcacttacggcctcaacactttcaccaacatggaagcccaactgatcagacagatggagggagaaggagtcttcaaaagtatccaacacctgacagtcacagaagagattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaaattaggaaagacatacaacaatgggaaccttcaagaggatggaacgattggacacaagtgcccttttgttcacaccatttccatgagttaatcatgaaagacggtcgtgtacttgtagttccatgtagaaaccaagatgaactgattggtagggcccgaatttcccagggagccgggtggtccttgcgggaaacagcttgtttggggaagtcttacgcccaaatgtggagcctgatgtacttccacagacgtgaccttaggctggcggcaaatgccatttgctcggcagttccatcacattgggttccaacaagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacattcaaacagcaataaatcaagttagatccctaataggcaatgaggaatacacagactacatgccatccatgaaaagattcagaagagaagaggaagaggcaggagtcttgtggtaa

SEQ ID NO: 7013 - RNA, 9876 nt, synthetic construct
  misc_feature 1..9876: note = derived and/or modified CDS sequence (wt) from DENV-2__KJ830750__SS-prME
  source 1..9876: mol_type = other RNA
accgcaggcgtgatcatcatgctaattccaacagcgatggcgtttcatttaaccacacgcaacggagaaccacacatgatcgtcagcaaacaagagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacgtggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtctcagggggaagttgggttgacatagtcttagaacatggaagctgtgtgacaacgatggcaaaaaacaagccaacattggactttgaactgataaaaacagaagctaagcaacctgccactctaaggaagtactgtatagaagcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcatcgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacagacaatggttcttagacctgccgttaccatggttgcccggagcggacatacaaggatcaaattggatacagaaggagacgctggtcactttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagggtacaatatgaaggggatggctctccatgtaaaatcccttttgagataatggatttggaaaaaagacatgtcttaggtcgcctgattacagtcaacccaatcgtcacaggaaaagacagtccagtcaacatagaagcagaacccccattcggagacagctacatcattataggagtggaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtttttggagcaatttatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacaaagaactgaaatgtggcagtgggattttcatcacagacaatgtacacacatggacagaacaatacaaattccaaccagaatccccctcaaagctggcatcagctatccagaaagctcatgaagaaggcatttgtggaatccgctcagtaacaagactggagaatctaatgtggaaacaaataacaccagaactgaatcacattctatcagaaaatgaggtaaagttgtctatcatgacaggggacatcaaaggaatcatgcaggcaggaaaacgatccctgcggcctcagcccactgagctcaaatattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgtcttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatggacagatcgacaacttctcactaggagtcttgggaatggcactgttcctggaagaaatgctcaggacccgagtaggaacaaaacatgcagtattactggttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagagtatacttgaactgactgatgcgttggctttgggcatgatgattctcaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagctagttctcttttgaagaatgacattcccatgacaggaccattagtggctggagggcttctcactgtgtgttacgtgctcactggaagatcggccgacctggaactagagaaagccgccgacgttagatgggaagatcaggcagaaatatcaggaagcagtccaattctatcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggacgttccttcacccccacctgtgggaaaggccgaactggaagatggagcttacagaatcaagcagaaagggattcttggatactcccagatcggagctggagtttacaaagaaggaacattccacacaatgtggcacgttacacgtggtgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacaccggaaccataggcgctgtgtccctagacttttctcctggaacatcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagatgatatctttcgaaaaaaaagattgaccattatggacctccatccaggagcgggaaagacgaaaagataccttccagcaatagttagagaagccataaaacgaggcttaagaacattaatcctggcccccactagagtcgtggcagctgaaatggaagaagctcttagaggacttccgataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcccccgggaagcagagacccatttcctcaaagcaatgcaccaatcatggatgaagaaagggaaatccctgaacgttcgtggaactctggacatgagtgggttacagatttcaaagggaagactgtttggtttgttccgagtataaaagcaggtaatgatatagcagcttgcctgaggaaaaatggaaagaaagtgatacaactcagtaggaagacctttgattctgaatacatcaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacttaccagtctggctggcctacagagtggcagccgaaggcattaactatgcagacagaaggtggtgttttgatggaattaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacggaaatgggtaggcttccaacttttatgactcagaaagcaaggaacgcactggacaacttagcagtcctgcacacggctgaagcaggcggaagggcgtacaatcatgctctcagtgaactgccagagactctggagacattgcttttgctgacacttttggccacagtcacgggcggaatctttttattcttgatgagtggcaaaggtatagggaaaatgaccctgggaatgtgctgcataatcacggccagtattctcctatggtacgcacaaatacagccacactggatagcagcctcaataatactggagttttttctcatagtcttgctcattccagagccagaaaagcaaagaacaccccaagacaaccaattgacttacgttgttatagccatcctcacagtggtggccgcaaccatggcaaatgagatggggttcttggaaaaaacgaagaaagatttcggattgggaagcattgcaatccagcaacccgagagcaacatcctggacatagatctacgtcctgcatcagcatggaccctgtatgcagtggccacaacatttatcacaccaatgttgagacacagcattgaaaattcctcagtgaacgtgtctctaacagccattgctaatcaagccacagtgctgatgggtcttgggaaaggatggccattgtcgaaaatggacattggagttccccttctcgccatcgggtgctattcacaagtcaaccccataaccctcacagcagcccttcttttattggtagcacattacgctatcatagggccaggactccaagctaaagcaaccagagaagcgcagaaaagagcagcagcaggcatcatgaaaaacccaactgtggatggagtaacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaacacaaccattgcagtgtcaatggctaacatttttagaggaagttacctagctggagctggacttctcttttccatcatgaagaatacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgtcttctttactccaccagaaaaatgtgacacattgttgtgtgatataggggagtcgtcaccaaatcccacggttgaagctggacgaacactcagagtcctaaacttggtagaaaactggctgaataacaacacccaattttgcataaaggttcttaacccatacatgccctcagttatagaaaaaatggaaacgctgcaaaggaaatacggaggagctttggtgaggaatcccctctcaagaaattccacacatgagatgtattgggtgtccaatgcttccgggaacatagtgtcatcagtgaacatgatttcaaggatgttgatcaatagatttacaatgagacataagaaggccacatacgagccagatgttgacctcggaagcggaacccgcaacatcggaatcgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaactcaagaaccgaaagaaggcacgaagaaactaatgaaaatcacggccgaatggctctggaaagaactagggaagaaaaagacacctaggatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacataccaaaacaaggtggtgcgtgtgcaaagacccacaccaagaggcacagtaatggatattatatcgagaagagaccaaagaggtagtggacaagttggcacctatggtctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtggttccatgtagaaaccaagatgaactgattggtagagctcgaatttcccagggagccgggtggtctctgcgggagacggcctgtctggggaagtcttacgcccaaatgtggagcctgatgtacttccacagacgtgacctcaggctggcagcaaacgctatctgctcggcagttccatcacattgggttccgacaagtcgaacaacctggtccatacacgccggacatgaatggatgacaacagaagacatgctgacagtctggaacagggtgtggattcaagaaaacccatggatggaagacaaaactccagtggaatcatgggaggaaatcccatacttgggaaaaagagaagaccaatggtgcggctcattgatagggttaacaagcagggccacctgggcaaggaacatccaaacagcaataaaccaagttagatccttaataggcagtgaggaatacacagactacatgccatccatgaaaagattcagaagagaagaggaagaggcaggggtcttgtggtag

SEQ ID NO: 7014 - RNA, 9876 nt, synthetic construct
  misc_feature 1..9876: note = derived and/or modified CDS sequence (wt) from DENV-2__FM210231__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaacgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcaccggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgctttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccagccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaagaaatgcttaggacccgagtaggaacgaagcatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattacaaaatgcatggaaagtgagttgcacaatactggcagtggtgtccgtttccccactgcttttgacatcctcacagcaaaaaacggattggataccattagcattgacaatcaagggtctcaatccaacagccatctttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctaaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgtaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggcctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaagcgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctgggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggatccgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7015 - RNA, 9876 nt, synthetic construct
  misc_feature 1..9876: note = derived and/or modified CDS sequence (wt) from DENV-2__FM210239__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacgatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgtaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacgacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaatcagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacattcactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagccaaaatgctcctagacaacatcaacacacctgaaggaatcattcctagtatgttcgaaccagagcgtgaaaaggtggatgccattgatggtgaataccgcttgagaggagaagcaaggaggacctttgtggacctaatgagaagaggggacttaccagtctggctggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctaggaatgtgctgcataatcacggctagcatcctcctatggtacgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaactaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgccaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggagattttggaacactactattgcagtgtcaatggccaacatttttagagggagctacttagctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaaggaaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacaaactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaattgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctggatggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7016 - RNA, 9876 nt, synthetic construct
  misc_feature 1..9876: note = derived and/or modified CDS sequence (wt) from DENV-2__FM210232__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgtaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagtcaatccgatcgtaacagaaaaagatagcccagtcaacatagaagcagaacctccattcggagacagctacatcattataggagtagagccgggacaattgaaactcaactggttcaagaaaggaagttccatcggacagatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacagcacaattacagaccaggctattacacgcaaacagcaggaccttggcatctaggtaagcttgagatggactttgatttctgcgaaggaactacagtggtggtgactgaggcctgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgccatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaggcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaatatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggctggcttacagagtggcagctgaaggcatcaactatgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgacccaagtactaatgatgaggactacatgggctttgtgtgaggctctaaccttagcgaccgggcccatctccacattgtgggaaggtaatccagggagattttggaacactactattgcagtgtcaatggccaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaataatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctggatggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7017 - RNA, 9876 nt, synthetic construct
  misc_feature 1..9876: note = derived and/or modified CDS sequence (wt) from DENV-2__FM210233__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtggaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgtagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcagaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatggaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtctcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggatacccttagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaagaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgaaagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaatacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcataggaaagatgaccctgggaatgtgctgcataatcacggctagcatccttctatggtacgcacagatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagagggatcttggattaggaagcattgcaacccagcaacccgagagcaacatcctggacatagacctacgtcccgcatcagcttggacgctgtatgccgtggctacaacattcgttacaccaatgctgagacacagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcgaaagaaggcatcaaaagaggagaaacggaccatcatgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaataccttcaccaatatggaagcccaattaatcagacagatggagggagaaggagtctttaaaaacatccagcacctgacagtcacagaagaagttgccgtgcataactggttggcaagagtggggcgcgaaaggttgtcaagaatggccatcagtggagatgattgtgttgtgaaacctttagatgacaggttcgcaaacgctttgacagccctaaatgacatgggaaagattagaaaagacatacaacaatgggaaccttcaaaaggatggaacgattggacacaagtgcccttctgttcacaccattttcatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7018 - RNA, 9876 nt, synthetic construct
  misc_feature 1..9876: note = derived and/or modified CDS sequence (wt) from DENV-2__FM210241__SS-prME
  source 1..9876: mol_type = other RNA
acagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacatgcaccaccacaggagaacacagaagagaaaaaagatcagtggcactcgttccacatgtgggtatgggactggagacacgaactgaaacatggatgtcgtcagaaggagcctggaaacacgctcagagaatcgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcgaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggatagaggatggggaaatggatgtggattatttggaaaaggaggcatcgtgacctgtgctatgtttacatgcaaaaagaacatggaaggaaaaatcgtgcagccagaaaatttggaatacaccatcgtgataacacctcactcaggagaagagcatgctgtaggtaatgacacaggaaaacatggtaaggaaatcaaaataacaccacagagttccatcacagaagcagaactgacaggctatggcacagttacgatggagtgctctccgagaacgggccttgactttaatgagatggtgctgctgcagatggaagacaaagcttggctggtgcacaggcagtggttcctagacctgccgttaccatggctacccggagcggacacacaaggatcaaattggatacagaaagagacactggtcactttcaaaaatccccacgcaaagaaacaggatgtcgttgttttaggatctcaagaaggggccatgcacacggcactcacaggggccacagagatccagatgtcatcaggaaacttactattcacaggacatctcaagtgcaggctgagaatggacaaactacagctcaaaggaatgtcatactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgtcttaggtcgcctgattacagtcaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccattttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagaacaatacaagttccaaccagaatccccttcaaaattagcttcagctatccagaaagctcatgaagagggcatttgtgggattcgctcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaaatcacacaccctctggagcaatggagtattagaaagtgagatgataattccaaaaagttttgctgggccagtgtcacaacacaactacagaccaggctattacacgcaaacagcaggaccttggcatctaggtaagcttgaaatggactttgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttgtgacattgattactgggaacatgtccttcagagacctgggaagagtgatggttatggtgggcgctaccatgacggatgacataggtatgggagtgacttatcttgccctactagcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtccttaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaggctatcatggctgtcgggatggtgagcattttggccagttccctcttaaagaatgacattcccatgacaggtccattagtggctggagggctccttactgtgtgctacgtgctcactggacgatcggccgacttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactctcagattggagccggagtttacaaagaaggaacattccatacaatgtggcacgtcacacgcggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgtccaaacgaaacctggacttttcaaaaccaacaccggaaccataggcgccgtatctctggacttttctcctggaacgtcaggatctccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcataccgggcgggagattgtggacctaatgtgtcatgccacgtttactatgaggctgctatcaccagtcagagtgccaaattacaacctgatcatcatggatgaagctcacttcacagacccagcaagtatagcagctagaggatacatttcaactcgagtagagatgggtgaggcagctgggattttcatgacagccactcctccgggaagtagagacccatttcctcagagcaatgcaccaatcatagatgaggaaagagaaatccctgagcgctcgtggaactctggacatgaatgggtcacggattttaaagggaagactgtttggtttgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaaaccagtcatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggagaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagacgcactggataacctagctgtgctgcatacggctgaggcaggtggaagagcgtataatcatgctctcagtgaactgccggagaccctggagacactgcttttactgacacttctggctacagttacgggaggaatcttcttattcttaatgagcggaaaaggtgtagggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggattgggaagcattgcaacccaggaacctgagagcaacatcctggacatagatctacgtcctgcgtcagcatggacgctgtacgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttctttcattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttgggacaagtaatgctcctaattctctgcgtgactcaagtattaatgatgaggactacatgggctctgtgtgaggctctaaccttagcgaccgggcccatctccacattgtgggaaggcaatccagggaggttttggaacaccaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtccttagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagctacctacgagccagatgttgacctagggagcggaacccgcaacattggaattgaaagtgagataccaaatctagacataataggaaagagaatagagaaaataaagcaagagcatgaaacatcgtggcactacgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagatagtaggttttgggagctggttgacaaggaaaggaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacactagaggacttaaaaaatgaagaaatggtgacaaaccacatggaaggagaacacaagagactagccgaggccatatttaaactaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaatttatcagacagatggagggagaaggaattttcaaaagcattcagcacctgacagtcacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttttgttcacaccattttcatgagttaatcatgaaagacggccgcgtgcttgtggttccatgcagaaaccaagatgaactgattggcagggcccgaatttcccagggagctgggtggtctttgaaggagacggcctgtttggggaagtcttacgcccaaatgtggagcctgatgtacttccacagacgtgacctcaggctggcggcaaatgctatttgctcggcagtcccgtcacattgggttcctacaagtcggacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaatatccaaacagcaataaatcaagtcagatcccttataggcaatgaagaatacacagattatatgccatccatgaagagattcagaagggaagaggaagaggcaggtgtcctgtggtag

SEQ ID NO: 7019 - RNA, 9876 nt, synthetic construct
  misc_feature 1..9876: note = derived and/or modified CDS sequence (wt) from DENV-2__FM210242__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaacgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccactctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgacaggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcgaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcaccggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgctttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccagccagaatccccttcaaaactagcttcagctatccagaaagctcaagaagagggaatttgtgggatccgctcggtaacaagattggagaacctaatgtggaaacaaataacaccagaactgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaagtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaagaaatgcttaggacccgagtaggaacgaagcatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtggtattgcaaaatgcatggaaagtgagttgcacaatactggcagtggtgtccgtttccccactgcttttgacatcctcacagcaaaaaacggattggataccattagcattgacaatcaagggtctcaatccaacagccatctttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcacacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgccgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcaaagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctaaccctgaacctaatcacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaagcgtaagagaagtgaaaggcctaacaaaaggaggaccaggacacgaagaacccattcctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctgggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaattaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaactaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgcccaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggatccgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7020 - RNA, 9876 nt, synthetic construct
  misc_feature 1..9876: note = derived and/or modified CDS sequence (wt) from DENV-2__FM210243__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagccttctgtttaaaacagaggatggtgtgaacatgtgtaccctcatggccattgatcttggtgaattgtgtgaagatacaatcacgtacaagtgccccctcctcaggcagaatgaaccagaagatatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacttggatcttgagacatccaggctttaccataatggcagcaatcctggcatataccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacaaggggaacccagtctaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagttccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggagccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggccaaatgtttgagacgacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggaatcataacactgtacttgggagctatggtgcaggctgatagtggttgcgttgtgagctggaaaaacaaagaactgaaatgtggcagcgggatcttcatcacagataacgtgcatacgtggacagaacaatacaagttccaaccagaatccccttcaaaattagcttcagctatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccctgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctactggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcactattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacttccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttttccactgctcttaacatcctcacagcagaaagcggattggataccactggcattgacgataaaaggtctcaatccaacagccatttttttaacaaccctttcgagaactagcaagaaaaggagctggccgctaaatgaggccatcatggcagtcgggatggttagcattttagccagttctctcttaaaaaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaaaaatccaagagctgtccaaacgaaacctggacttttcaaaaccaacaccggaaccataggcgccgtatctttggacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagctatagttagagaggccataaaacgtggcttgagaacattaatcctggcccccactagagtcgtggcagctgaaatggaggaggctcttagaggacttccaataagataccaaaccccagccatcagagccgagcacaccggacgggagattgtggacctaatgtgtcacgccacatttaccatgagactgctatcaccagtcagagtgccaaattacaacctgatcatcatggatgaagctcacttcacagacccagcaagtatagcagctagaggatacatttcaactcgagtagagatgggtgaggcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagggtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggcagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcctattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgtcatagccatcctcacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcctatctccacattgtgggaaggtaatccagggaggttttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactgggaaagagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggaccttggttgcggcagagggggctggtcatactattgtgggggactaaagaatgtaagagaagtcaaaggcctgacaaaaggaggaccaggacacgaagaaccaatccccatgtcaacatatggatggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtaaacatgatctcaaggatgctgattaacagattcacaatgaaacacaagaaagccacctacgagccagatgttgacttagggagcggaacccgtaacattggaattgaaagtgagataccaaatctagacataataggaaagagaatagagaaaataaaacaagagcatgaaacatcgtggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgcaccagagaagaattcacaagaaaagtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggcaaggcaaaaggtagcagagccatatggtacatgtggcttggagcacgcttcttggagtttgaagccttgggattcttgaatgaagatcactggttctccagagagaactccctgagtggagtggaaggagaagggctgcacaagctgggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccattttcaaattaacgtaccaaaacaaggtggtgcgtgtgcaaagaccaacaccaagaggcacagtaatggatatcatatcgaggagagaccaaagaggcagtgggcaagtcggcacctatggcctcaacactttcaccaatatggaagcccaattaattagacagatggagggagaaggaattttcaaaagcattcagcacctgacagtcacagaagaaatcgctgtgcagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgtagaaaccaagatgaactgattggcagggcccgaatttcccagggagctgggtggtctttgaaggagacggcctgtttggggaagtcttacgctcaaatgtggagtctgatgtacttccacagacgtgacctcaggctggcggcaaatgcaatttgctcggcagtcccgtcacattgggtcccaacaagtcgaacaacctggtcaatacacgccaagcatgaatggatgacgacggaagacatgctgacagtttggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7021 - RNA, 9876 nt, synthetic construct
  misc_feature 1..9876: note = derived and/or modified CDS sequence (wt) from DENV-2__FM210244__SS-prME
  source 1..9876: mol_type = other RNA
acagcaggcgtgattattatgttaattccaacagcgatggcgttccatttaaccacacgtaatggagaaccacacatgatcgttggcagacaagagaaagggaaaagtcttctgtttaaaacagaggatggtgtgaacatgtgtaccctcatggccattgatcttggtgaattgtgtgaagatacaatcacgtacaagtgccccctcctcaggcagaatgaaccagaagatatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggattttgagacatccaggctttaccataatggcagcaatcctggcatacaccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaactgaagccaaacaacctgccactctaaggaagtactgtatagaggcaaagctgaccaatacaacaacagaatctcgttgcccaacacaaggggaacccagtctaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggcctcgacttcaatgagatggtgctgctgcagatggaagataaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggccaaatgtttgagacaacaatgagaggagcaaagagaatggctattttaggtgacacagcctgggattttggatctctgggaggagtgtttacatctataggaaaggctctccaccaagtttttggagcaatttatggggccgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtaagctggaaaaacaaagaactgaaatgtggcagcgggatcttcatcacagataacgtgcatacgtggacagaacaatacaagttccaaccagaatccccttcaaaattagcttcagctatccaaaaagctcatgaagagggtatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatcccacaaccagacctttctcattgatggccctgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagttaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggacggatgctggtatgggatggaaatcagaccattaaaagagaaagaagagaatttggtcaactccctggtcacagccggacatgggcagattgacaacttttcactaggagtcttgggaatggcactattcctggaagaaatgctcaggacacgagtaggaacgaaacatgcaatactgctagttgcagtttcttttgtgacattgatcactgggaacatgtcctttagagatttgggaagagtaatggttatggtgggcgctgccatgacggatgacataggtataggagtgacttatcttgccctactggcagctttcaaagtaagaccaacttttgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgaccatcatggccatctcgtgtgtcccaaatgcagtgatactgcaaaacgcatggaaggtgagctgcacaatattggcaacggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttgaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctagcattggaacctgggaaaaatccaagagctgtccaaacgaaacctggacttttcaaaaccaacaccggaaccataggcgccgtatctttggacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagttgagatgggtgaagcagctgggattttcatgacagccactcctccgggaagtaaagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgctgcatgaaaccagttatattaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactatgcagacagaaggtggtgttttgatggagttaagaacaaccaaatactagaagaaaacgtggaagtggaaatttggacaaaagaaggggaaaggaaaaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactagataacctagctgtgctgcatacggctgaggcaggtggaaaggcgtacaatcatgctctcagtgaactgccggagacccttgagacactacttttactgacactcctggctacagtcacgggaggaattttcttattcttaatgagtggaaaaggtgtagggaagatgaccctgggaatgtgctgcataataacggctagcatcctcctatggcatgcacagatacaaccacactggatagcagcttcaataatattggagttttttctcatagttttgctcattccagagccagaaaaacagagaacaccccaagataaccaactgacctacgttgtcatagccatcctcacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggacttcaagcgaaagcaactagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtattaatgatgaggactacatgggctttgtgtgaggctctaaccttagcgaccgggcccatctccacattgtgggaaggtaatccagggaggttttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcgtcagtgaacatgatctcaaggatgctgattaacagattcacaatgaaacacaagaaagccacctacgagccagatgttgacctagggagcggaacccgcaacattggaattgagagtgagatgccaaatctagacataataggaaagagaatagagaaaataaaacaagagcatgaaacatcatggcactatgaccaggaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgtgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagctttgggggccatattcactgatgagaacaaatggaagtcggcacgcgaggctgttgaagatagtaggttttgggagctggttgacaaggaaagaaatctccatcttgaagggaagtgtgaaacatgtgtgtacaacatgatgggaaagagagaaaagaaactaggggagttcggcaaggcaaaaggtagcagagccatatggtacatgtggcttggagcacgcttcttggagtttgaagccttgggattcttgaatgaggatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggcacctatggccttaacactttcaccaatatggaagcccaactaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccatttccatgagttaatcatgaaagatggtcgcgtgctcgtagttccatgcagaaaccaagatgaactgatcggcagggcccgaatttcccagggagctgggtggtctctgaaggagacggcctgtttggggaagtcttacgctcaaatgtggagtctgatgtacttccacagacgtgacctcaggctggcggcaaacgccatttgctcggcagtcccgtcacattgggttccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgatcgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7022 - RNA, 9876 nt, synthetic construct
  misc_feature 1..9876: note = derived and/or modified CDS sequence (wt) from DENV-2__FM210234__SS-prME
  source 1..9876: mol_type = other RNA
acagcaggcgtgattattatgttaattccaacagcgatggcgttccatttaaccacacgtaatggagaaccacacatgatcgttggcagacaagagaaagggaaaagtcttctgtttaaaacagaggatggtgtgaacatgtgtaccctcatggccattgatcttggtgaattgtgtgaagatacaatcacgtacaagtgccccctcctcaggcagaatgaaccagaagatatagattgttggtgcaactccacgtccacatgggtaacttatgggacgtgtaccaccacaggagaacacagaagagaaaaaagatcagtggcactcgttccacatgtgggtatgggactggagacgcgaactgaaacatggatgtcgtcagaaggggcctggaaacacgctcagagaattgaaacctggattttgagacatccaggctttaccataatggcagcaatcctggcatacaccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccgacattggattttgaactgataaaaactgaagccaaacaacctgccactctaaggaagtactgtatagaggcaaagctgaccaatacaacaacagaatctcgttgcccaacacaaggggaacccagtctaaatgaagagcaggacaaaaggttcgtctgcaaacactccatggtagacagaggatggggaaatggatgtggattatttggaaagggaggcattgtgacctgtgctatgtttacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctagtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacaggaaaagatagcccagtcaacatagaagcagaacctccattcggagacagctacatcattataggagtagagccgggacaattgaaactcaactggttcaagaaaggaagttccatcggccaaatgtttgagacaacaatgagaggagcaaagagaatggctattttaggtgatacagcctgggattttggatccctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcatacgtggacagaacaatacaagttccagccagaatccccttcaaaattagcttcagctatccaaaaagctcatgaagagggtatttgtggaatccgctcagtaacaaggttggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccctgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagttaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaattgcactattcctggaagaaatgctcaggacacgagtaggaacgaaacatgcaatactgctagttgcagtttcttttgtgacattgattactgggaacatgtcctttagagatctgggaagagtgatggttatggtgggcgctgccatgacggatgacataggtatgggagtgacttatcttgccctactggcagctttcaaagtaagaccaacttttgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatactgcaaaacgcatggaaggtgagctgcacaatattggcaacggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcattggaacctgggaaaaatccaagagctgtccaaacgaaacctggacttttcaaaaccaacaccggaaccataggcgccgtatctttggacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggatctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggatcttcatgacagccactcctccgggaagtagagacccatttccacagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggacaaatgattgggactttgtggtcacaaccgacatttcagaaatgggtgccaacttcaaggctgagagggttatagaccccagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactatgcagacagaaggtggtgttttgatggagttaagaacaaccaaatactagaagaaaacgtggaagtggaaatttggacaaaagaaggggaaaggaagaaattaaaacccagatggttggatgctaggatctattctgacccattggcactaaaagaattcaaggaatttgcggctggaagaaagtccttgaccctgaacctaatcacagaaatgggtagacttccaactttcatgacccagaaggcaagagacgcactagataacctagctgtgctgcatacggctgaagcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggcatgcacagatacaaccacactggatagcagcttcaataatattggagttttttctcatagttttgctcattccagagccagaaaaacagagaacaccccaagataaccaactgacctacgttgtcatagccatcctcacagtggtggccgcaaccatggcaaacgagatgggtttcttggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggacttcaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtattaatgatgaggactacatgggctttgtgtgaggctctgaccttagcgaccgggcccatctccacattgtgggaaggtaatccagggaggttttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattgaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaaccaatccccatgtcaacatatgggtggaatctagtacgcctgcagagtggagttgatgtttttttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcgtcagtgaacatgatctcaaggatgctgattaacagattcacaatgaaacacaagaaagccacctacgagccagatgttgacctagggagcggaacccgcaacattggaattgagagtgagataccaaatctagacataataggaaagagaatagagaaaataaaacaagagcatgaaacatcatggcactatgaccaggaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgtgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcagcacgcgaggctgttgaagatagtaggttttgggagctggttgacaaggaaagaaatctccatcttgaagggaaatgtgaaacatgtgtgtacaacatgatgggaaagagagaaaagaaactaggggagttcgggaaggcaaaaggtagcagagccatatggtacatgtggcttggagcacgcttcctggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagatttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggcacctatggccttaacactttcaccaatatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtccctgaaggagacggcctgtttggggaagtcttacgctcaaatgtggagtctgatgtactttcacagacgtgacctcaggctggcggcaaacgccatttgctcggcagtcccgtcacattgggttccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7023 - RNA, 9876 nt, synthetic construct
  misc_feature 1..9876: note = derived and/or modified CDS sequence (wt) from DENV-2__FM210213__SS-prME
  source 1..9876: mol_type = other RNA
acagcaggcgtgattattatgttaattccaacagcgatggcgttccatttaaccacacgcaatggagaaccacacatgatcgttggcagacaagagaaagggaaaagtcttctgtttaaaacagaggatggtgtgaacatgtgcaccctcatggccattgatcttggtgaattgtgtgaagatacaatcacgtacaagtgccccctcctcaggcagaatgaaccagaagatatagattgctggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggattttgagacatccaggctttaccataatggcagcaatcctggcatacaccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaactgaagccaaacaacctgccactctaaggaagtactgtatagaggcaaagctgaccaatacaacaacagaatctcgttgcccaacacaaggggaacccagtctaaatgaagaacaggacaaaaggttcgtctgcaaacactccatggtagacagaggatggggaaatggatgtggattatttggaaagggaggcattgtgacctgtgctatgttcacgtgcaaaaagaacatggaaggaaaaatcgtgcaaccagaaaatttggaatacaccatcgtgataacacctcactcaggagaagagcacgctgtaggtaatgacacagggaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactattcacaggacatctcaaatgtaggctgagaatggacaaactacagctcaaaggaatgtcatactctatgtgtacaggaaagtttaaaatcgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggccaaatgtttgagacaacaatgagaggagcaaagagaatggctattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcattagtattggtgggagtcataacactgtacttgggagctatggtgcaggctgatagtggttgcgttgtgagctggaaaaacaaagaactgaaatgtggcagcgggatcttcatcacagataacgtgcatacgtggacagaacaatacaagttccaaccagaatccccttcaaaattagcttcagctatccaaaaagctcatgaagagggtatttgtggaatccgctcagtaacaagattggagaatctgatgtggaaacagataacaccagaattgaatcacattctatcagaaaatgaggtaaagttgaccattatgacaggagacattaaaggaatcatgcaggcaggaaaacgatctctgcggccccagcctactgagctgaagtattcatggaaaacatggggaaaggcgaaaatgctctccacagaatctcacaaccagacctttctcattgatggccctgaaacagcagaatgccccaacacaaacagagcttggaactcgctggaagttgaagactatggttttggagttttcaccaccaacatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagttaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctctaagaacgaccactgcctctggaaaactcataacagaatggtgctgccgatcctgtacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcactattcctggaagaaatgctcaggacacgagtaggaacgaaacatgcaatactgctagttgcagtttcttttgtgacattaattactgggaacatgtcctttagagatctgggaagagtgatggttatggtgggcgctgccatgacggatgacataggtatgggagtgacttatcttgccctactggcagctttcaaagtaagaccaacttttgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcaacggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggtcagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacctccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcattggaacctgggaaaaatccaagagctgtccaaacgaaacctggacttttcaaaaccaacaccggaaccataggcgccgtatctttggacttttcccctggaacgtcaggatctccaattgtcgatagaaaaggaaaagttgtgggtctatatggcaatggtgttgtcacaaggagtggagcatacgtgagtgctatagcccagaccgaaaaaagcattgaagacaatccagaaatcgaagatgacattttccgaaagaaaagattgactatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcataccgggcgggaaattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccggggagtagagacccatttcctcagagcaatgcaccaatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaactgacatctcagaaatgggtgccaacttcaaggctgagagggttatagaccccagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactatgcagacagaaggtggtgttttgatggagttaagaacaaccaaatactagaagaaaatgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagaaacgcactagataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggcatgcacagatacaaccacactggatagcagcttcaataatattggagttttttctcatagttttgctcattccagagccagaaaaacagagaacaccccaagataaccaactgacctacgttgtcatagccatcctcacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacactgtatgccgtggctacaacatttgtcacaccaatgttgagacatagcattgaaaactcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggacttcaagcgaaagcaaccagagaagctcagaaaagagcagcagcaggcatcatgaaaaatccaacagtcgatggaataacagtgattgacctagatccaataccctatgatccaaaatttgaaaaacagctaggacaagtaatgctcctgattctctgcgtgactcaagtattaatgatgaggactacatgggctttgtgtgaggctctaaccttagcgaccgggcccatctccacattgtgggaaggtaatccagggaggttttggaacactactattgcagtgtcaatggctaacatttttagagggagctacttggctggagctggacttcttttttccatcatgaagaacacaacaaacacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggagagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacctagggagcggaacccgcaacattggaattgaaagtgagataccaaatctagacataataggaaagagaatagagaaaataaaacaagagcatgagacatcatggcactatgaccaagaccacccatacaaaacatgggcttaccatggcagctatgaaacaaaacagactggatcagcatcatccatggtgaatggagtggtcagactgctgacaaaaccttgggacgtcgtccctatggtaacacagatggcaatgacagacacgactccatttggacaacagcgtgttttcaaagagaaagtggacacgagaacccaagaaccgaaggaaggcacaaagaaactgatgaaaatcacggcagagtggctttggaaagaactaggaaagaaaaagacacctaggatgtgtaccagagaagaattcacaagaaaagtaagaagcaatgcagccttgggggccatattcactgatgagaacaaatggaagtcggcacgcgaggctgttgaagatagtaggttttgggagctggttgacaaggaaagaaatctccatcttgaagggaagtgtgaaacatgtgtgtacaacatgatgggaaagagagaaaagaaactaggagagttcggcaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggcacctatggccttaacactttcaccaatatggaagcccaattaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgatatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctctgaaggagacggcctgtttggggaagtcttacgctcaaatgtggagtctgatgtacttccacagacgtgacctcaggctggcggcaaatgctatttgctcggcagtcccgtcacattgggttccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 7024 - RNA, 9876 nt, synthetic construct
  misc_feature 1..9876: note = derived and/or modified CDS sequence (wt) from DENV-2__FM210235__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggttttaccataatggcagcaatcctggcatacactgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcagacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacaaagtcccatcacagaagcagaactgacaggctatggcacagtcacgatggagtgctctccgagaacgggccttgacttcaatgagatggtgctgctgcagatggaggataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatcgcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctagaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacactaccacctctaagatacaggggtgaggatggatgctggtatgggatggaaatcagaccattaaaagagaaagaagagaatttggtcaactccttggtcacagccggacatgggcagattgacaacttttcactaggagtcttgggaatggcattattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggaatggtcgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttagaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctatgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggcgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggttgatgccattgatggtgaataccgcttgagaggagaagcaaggaagacctttgtggacctaatgagaagaggggacttaccagtctggttggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatccttacagtggtggccgcaaccatggcaaacgagatgggtttcctagaaaaaaccaagaaagacctcggattgggaagcattgcaacccgggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggagattttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaatatggtcacaccagaagggaaagtggtggaccttggttgcggcagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgtcttcttcactccgccagaaaagtgtgacacactgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgccactgggaacatagtgtcatcagtgaacatgatttcaaggatgctgattaacagattcacaatgaaacacaagaaagccacctacgagccagatgttgatttagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcgatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgtggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7025 - RNA, 9876 nt, synthetic construct
  misc_feature 1..9876: note = derived and/or modified CDS sequence (wt) from DENV-2__FM210205__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctaagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagatagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatccataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgtgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgaaaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttctccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacatttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccgagagccgtccaaacaaaacctggtcttttcaaaaccaacaccggaacaataggtgccgtatctctggacttttcccctggaacgtcaggatctccaatcatcgacaaaaaaggaaaagttgtgggtctttatggcaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagcagagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgttaaaagagttcaaagaatttgcagccggaagaaagtctctgaccctgaacctaattacagaaatgggtaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggattttggattaggaagcattgcaacccagcaacccgagagcaacatcctggacatagacctacgtcccgcatcagcttggacgctgtatgccgtggctacaacattcgttacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacataggagagacgcttggagagaaatggaaaagccgattgaacgcactgggaaaaagtgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggcagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaattgatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaaaaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtgcttgttgttccatgtagaaaccaagatgaactgattggcagagcccgaatctcccaaggagcagggtggtctttgcgggagacggcctgcttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7026 - RNA, 9876 nt, synthetic construct
  misc_feature 1..9876: note = derived and/or modified CDS sequence (wt) from DENV-2__FM210206__SS-prME
  source 1..9876: mol_type = other RNA
tctgcaggtatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacgtgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccctaatggcagcaatcctggcatacaccatagggacgacacatttccagagagtcttgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacaaaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcattataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaatcgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcgaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccatagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacataccctctggagtaatggagtgctagaaagtgagatgataatcccaaagaatctcgctggaccagtgtctcaacacaactatagaccaggctaccatacacaaatagcaggaccatggcacctaggtaagcttgagatggacttcgatttctgcgatggaactacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaattccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagtcagaccaacttttgcagctgggctactcttgagaaagctgacctccaaggaattgatgatgactaccataggaattgtactcctctcccaaagtactataccagagaccgttcttgaattgactgatgcgttagccttaggcatgatggtcctcaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagctagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattattatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtaacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataatattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacagctgaagcaggtggaagggcgtacaatcatgctctcagtgaactgccggagaccctagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgccctgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagcactcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcgaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaacctggtgcgtctccagagtggagttgacgtcttcttcatcccgccagaaaagtgtgacacattgttgtgtgacataggggagtcatcgccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgcaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgctaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7027 - RNA, 9876 nt, synthetic construct
  misc_feature 1..9876: note = derived and/or modified CDS sequence (wt) from DENV-2__FM210246__SS-prME
  source 1..9876: mol_type = other RNA
tctgcaggtatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggccatggaccttggtgaattgtgtgaagacacaatcacgtacaagtgtcctcttctcaggcagaatgagccagaagacatagactgttggtgcaactccacgtccacgtgggtaacctatgggacttgtaccaccacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcctggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcctcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttttaaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgcggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtatctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacgaggtttgagaacattaatcctggcccccactagagttgtggcagctgaaatggaggaagctctcagaggacttccaataagataccaaaccccagccatcagagctgagcacactgggcgggagattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagcaaaaatgctcctagataacatcaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaaaaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaactgccagagactttagagacactgcttttactgacacttctggctacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagtcttgcttattccagaaccagaaaaacagagaacaccccaagacaaccaactgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttaggacaagtaatgctactaatcctctgcgtgactcaagtattgatgatgaggactacatgggctctgtgtgaggccttaaccttagctacagggcccatctccacactgtgggaaggaaatccaggaaggttctggaacactaccattgcggtgtcaatggctaacatctttagagggagttacttggctggagctggacttctcttttccattatgaagaacacaaccaacacaagaaggggaactggcaacatgggagagacgcttggagagaaatggaaaagccgattgaacgcactgggaaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccgctctcacggaactccacgcatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgcaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagttggttgacaaggaaaggaatctccatcttgaaggaaagtgtgagacatgtgtgtacaacatgatgggaaaaagagaaaagaagctaggggaattcggcaaggcaaaaggcagcagagccatatggtacatgtggcttggagcccgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccaaagaggtagtgggcaagttggtacctatggactcaatactttcaccaatatggaagcccaattaatcagacagatggagggagaaggagtctttaaaaacatccagcacctgacagtcacagaagaagttgccgtgaaaaactggttggcaagagtggggcgcgaaaggttgtcaagaatggccatcagtggagatgattgtgttgtgaaacctttagatgacaggttcgcaaacgctttgacagccctaaatgacatgggaaagattagaaaagatatacaacagtgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 7028 - RNA, 9876 nt, synthetic construct
  misc_feature 1..9876: note = derived and/or modified CDS sequence (wt) from DENV-2__FM210207__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagacatagactgttggtgcaactccacgtccacatgggtaacctatgggacctgtaccactacgggagaacatagaagagaaaaaagatcagtggcactcgttccacatgtgggaatgggactggagacgcgaaccgaaacatggatgtcatcagaaggggcttggaaacatgcccagagaattgaaacttggatcctgagacatccaggcttcaccataatggcagcaatcctggcatacaccatagggacgacacatttccagagagtcctgattttcattctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacgttggatttcgaactgataaaaacggaagccaaacagcctgccaccctaaggaagtactgcatagaagcaaagctaaccaacacaacaacagaatcccgttgcccaacacaaggggaacccagcctaaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaggagcatgcggtcggaaatgacacaggaaaacacggcaaggaaatcaaagtaacaccacagagttccatcacagaagcagaattgaccggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatcccaagaaggggccatgcatacagcactcacaggagccacagaaatccaaatgtcgtcaggaaacttgctcttcactggacatctcaagtgcaggctgagaatggacaagctacagcttaaaggaatgtcatactccatgtgcacaggaaagtttaaagttgtgaaggaaatagcagaaacacaacatggaacgatagtcatcagagtgcaatatgaaggggacggctctccatgtaaaatcccttttgagataatggatttggaaaaaagatatgtcttaggccgcctgatcacagtcaacccaattgtaacagaaaaagacagcccagtcaacatagaagcagaacctccattcggagacagctacatcatcataggagtagagccgggacaactgaagctcaactggttcaagaaaggaagttctatcggccaaatgtttgagacaacgatgagaggggcgaagagaatggccattttgggtgacacagcctgggactttggatccctaggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaagaagagggaatttgtgggatccgctcggtaacaagattggagaacctaatgtggaaacaaataacaccagaattgaatcacattctagcagaaaatgaggtgaagttgactattatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcaccaccaatatatggctaaaattgaaagaaaaacaggatgcattctgcgactcaaaactcatgtcggcggccataaaagacaacagagccgtccatgccgacatgggttactggatagaaagtgcactcaatgacacatggaagatagagaaagcctctttcattgaggtaaaaaactgccactggccaaaatcacacaccctctggagtaatggagtgctagaaagtgagatgataatcccaaagaatctcgctggaccagtgtctcaacacaactatagaccaggctaccatacacaaatagcaggaccatggcacctaggtaagcttgagatggactttgatttctgcgatggaaccacagtgatagtgactgaggactgtggaaatagaggaccctctttgagaacaactactgcctctggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgctacaatggcggatgacataggtatgggcgtgacttatcttgccctactagcagccttcaaagttagaccaacttttgcagctgggctactcttgagaaagctgacctccaaggaattgatgatgactaccataggaattgtactcctctcccaaagtactataccagagaccgttcttgaattgactgatgcgttagccttaggcatgatggtccttaaaatagtaagaaacatggaaaagtatcaattagcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaaaggtctcaatccaacagccatttttctaacaaccctctcaagaaccaacaagaaaagaagctggccactaaatgaggctatcatggcagtcggaatggtgagcattttagccagttccctcctaaaaaatgatattcccatgacaggaccactagtggctggagggctcctcactgtgtgctacgtgctcactggacgatcggccgacttggaactggagagagcaaccgatgtcaaatgggaagaccaggcagagatatcaggaagcagcccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggattcttggatattctcagatcggagctggagtttacaaagaaggaacttttcatacaatgtggcatgtcacacgtggcgctgttctaatgcataaaggaaagaggattgaaccttcatgggcggacgtcaaaaaagatctaatatcatatggaggaggctggaagctagaaggagaatggaaggaaggagaagaagtccaggtgctggcactggagcctggaaaaaatccaagagccgtccaaacaaaacctggtcttttcaaaaccaacaccggaacaataggtgctgtatctctggacttttcccctggaacgtcaggatctccaatcatcgacaaaaaaggaaaagttgtgggtctttatggtaatggtgttgtcacaaggagtggagcatatgtgagtgctatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactataacttgattatcatggacgaagcccatttcacagacccagcaagtatagcagctagaggatacatctcaacccgagtggaaatgggtgaggcagctgggattttcatgacagccactcccccgggaagtagagatccatttcctcagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaacttagtaggaagacttttgattctgagtatgtcaagactagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacctatgccagtgacccattctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgtgaaaaagtggatgccattgatggcgaataccgtttgagaggagaagcaaggaaaacatttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagagttcaaagaatttgcagccggaagaaagtctctgaccctgaacctaatcacagaaatgggtaggcttccaacattcatgactcagaagacaagagacgcactggacaacctagcagtgctgcacacggctgaagcaggtggaagggcgtacaatcatgctctcagtgaattgccggagaccctagagacactgcttttactgacacttctggccacagtcacaggagggatctttttattcttgatgagcgggaggggcatagggaagatgaccctgggaatgtgctgcataatcacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatcctcacagtggtggccgcaaccatggcaaacgagatgggtttcctagaaaaaacgaagaaggatcttggattaggaagcattgcaacccagcaacccgagagcaacatcctggacatagacctacgtcccgcatcagcttggacgctgtatgccgtggctacaacatttgttacaccaatgctgagacatagcattgagaattcctcagtgaatgtatccctaacagctatagccaaccaagcgacagtgttaatgggtctagggaaaggatggccattgtcaaagatggacatcggagttccccttctcgccattggatgttactcacaagtcaatcccataactctcacagcagctctcctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaagtattgatgatgaggactacatgggctctgtgtgaggccttaaccttagccacagggcccatctccacactgtgggaaggaaatccaggaaggttctggaacactaccattgcggtgtcaatggctaacatcttcagagggagttacttggctggagctggacttctcttttccattatgaagaacacaaccaacacaagaaggggaactggcaacatgggagagacgcttggagagaaatggaaaagccgattgaacgcactgggaaaaaatgaattccagatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactattgtggaggactaaaaaacgtaagagaagtgaaaggcctaacaaaaggaggaccaggacacgaagaacccatccctatgtcaacatatgggtggaatctggtgcgtcttcagagtggagttgacgtcttcttcatcccgccagaaaagtgtgacacattgttgtgtgacataggggagtcatcaccaaatcccacagtggaagcaggacgaacactcagagtccttaatttagtagaaaattggttgaacaacaacactcaattttgcataaaagttctcaacccatatatgccctcagttatagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacccgaaacattggaattgaaagtgaaataccaaacctagacataattgggaaaagaatagaaaaaataaagcaagagcatgaaacatcatggcactacgaccaagaccacccatacaaaacgtgggcataccatggtagctatgaaacaaaacagactggatcagcatcatccatggtcaacggagtggtcaggctgctgacaaaaccttgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaagctaggggaattcggcaaggcaaaaggcagcagagccatatggtatatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggaacagtaatggacatcatatcgagaagagaccagagaggtagtgggcaagttggtacctatggactcaatactttcaccaatatggaagcccaattaatcagacagatggagggagaaggagtctttaaaaacatccagcacctgacagtcacagaagaagttgccgtgcaaaactggttggcaagagtggggcgcgaaaggttgtcaagaatggccatcagtggagatgattgtgttgtgaaacctttagatgacaggttcgcaaacgctctgacagccctaaatgacatgggaaagattagaaaagatatacaacagtgggaaccttcaaaaggatggaacgattggacacaagtgcccttctgttcacaccatttccatgagctaattatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcagcagtgccatcacactgggttccaacaagtcgaacaacctggtccatgcacgccaaacatgaatggatgacaacggaagacatgttgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcggcaataaatcaggttagatctcttataggcaatgaggaatacacagattacatgccatccatgaaaagattcagaagagaagaggaagaagcaggagtcctgtggtaa

SEQ ID NO: 7029 - RNA, 9876 nt, synthetic construct
  misc_feature 1..9876: note = derived and/or modified CDS sequence (wt) from DENV-2__FM210238__SS-prME
  source 1..9876: mol_type = other RNA
acggcaggcatgatcattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgatcttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaatcctggcatacaccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacaaggggaacccagtctaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaagaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggccaaatgtttgagacaacaatgagaggagcaaagagaatggccattttaggtgacacagcctgggattttggatctctgggaggagtgtttacatctataggaaaggctctccaccaagttttcggagcaatctatggggctgccttcagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcactattcctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaactttcgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttagacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaggcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactacgcagacagaaggtggtgttttgatggagttaagaacgaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggaggttttggaacaccactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggaccttggttgcggcagagggggctggtcatactattgtgggggactaaagaatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggcaaggcaaaaggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggcacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgtttggggaagtcttacgctcaaatgtggagtctgatgtacttccacagacgtgacctcaggctggcggcaaatgctatttgctcggcagtcccgtcacattgggtcccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7030 - RNA, 9876 nt, synthetic construct
  misc_feature 1..9876: note = derived and/or modified CDS sequence (wt) from DENV-2__FM210224__SS-prME
  source 1..9876: mol_type = other RNA
acagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccagaaaatttggaatacaccatcgtgataacacctcactcaggagaagagcatgctgtaggtaatgacacaggaaaacatggtaaggaaatcaaaataacaccacagagttccatcacagaagcagaactgacaggctatggcacagttacgatggagtgctctccgagaacgggccttgactttaatgagatggtgctgctgcagatggaagacaaagcttggctggtgcacaggcagtggttcctagacctgccgttaccatggctacccggagcggacacacaaggatcaaattggatacagaaagagacactggtcactttcaaaaatccccacgcgaagaaacaggatgtcgttgttttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgtcttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccattttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagaacaatacaagttccaaccagaatccccttcaaaattagcttcagctatccagaaagctcatgaagagggcatttgtgggattcgctcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagcttgaaatggactttgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtccttaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaggctatcatggctgtcgggatggtgagcattttagccagttccctcttaaagaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgtccaaacgaaacctggacttttcaaaaccaacaccggaaccataggcgccgtatctctggacttttctcctggaacgtcaggatctccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcataccgggcgggagattgtggacctaatgtgtcatgccacgtttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgctcgtggaactctggacatgaatgggtcacggattttaaagggaagactgtttggtttgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagctaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagacgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttgggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagctacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacactagaggacttaaaaaatgaagaaatggtgacaaaccacatggaaggagaacacaagagactagccgaggccatattcaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagttacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttttgttcacaccattttcatgagttaatcatgaaagacggccgcgtgcttgtggttccatgcagaaaccaagatgaactgattggcagggcccgaatttcccagggagctgggtggtctttgaaggagacggcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaatatccaaacagcaataaatcaagtcagatcccttataggcaatgaagaatacacagattacatgccatccatgaagagattcagaagggaagaggaagaggcaggtgtcctgtggtag

SEQ ID NO: 7031 - RNA, 9876 nt, synthetic construct
  misc_feature 1..9876: note = derived and/or modified CDS sequence (wt) from DENV-2__FM210225__SS-prME
  source 1..9876: mol_type = other RNA
acagcaggcgtgattattatgttgattccaacagcgatggcgttccatctaaccacacgtaatggagaaccacacatgatcgttggtagacaagagaaagggaaaagtcttctgttcaaaacggaggatggtgtgaacatgtgtaccctcatggccatagatcttggtgaattgtgtgaagatacaatcacgtacaagtgccccctcctcaggcagaatgaaccagaagacatagattgttggtgtaactccacgtccacatgggtaacttatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactttaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattatttggaaagggaggcatcgtgacctgtgctatgtttacatgcaaaaagaacatggaaggaaaaatcgtgcagccagaaaatttggaatacaccatcgtgataacacctcactcaggagaagagcatgctgtaggtaatgacacaggaaaacatggtaaggaaatcaaaataacaccacagagttccatcacagaagcagaactgacaggctatggcacagttacgatggagtgctctccgagaacgggccttgacttcaatgagatggtgctgctgcagatggaagacaaagcttggctggtgcacaggcagtggttcctagacctgccgttaccatggctacccggagcggacacacaaggatcaaattggatacagaaagagacactggtcactttcaaaaatccccacgcgaagaaacaggatgtcgttgttttaggatctcaagaaggggccatgcacacggcactcacaggggccacagagatccagatgtcatcaggaaacttactattcacaggacatctcaagtgcaggctgagaatggacaaactacagctcaaaggaatgtcatactctatgtgcacaggaaagttcaaaattgtgaaggaaatagcagaaacacaacatggaacaatagttattagagtacaatatgaaggagacggctctccatgtaagatcccttttgaaataatggatttagaaaaaagacatgtcttaggtcgcctgattacagttaacccgatcgtaacagaaaaagatagcccagtcaacatagaagcagaacctccattcggagacagctacatcattataggagtagagccgggacaattgaaactcaactggtttaagaaaggaagttccattggccaaatgtttgagacaacaatgagaggagcgaagaggatggccattttaggtgacacagcctgggattttggatccctaggaggagtgtttacatctataggaaaagctctccaccaagttttcggagcaatctatggggctgcctttagtggggtctcatggactatgaaaatcctcataggagccatcatcacatggataggaatgaattcacgtagcacctcactgtctgtgtcactagtattggtgggagtcataacactgtacttgggagccatggtgcaggctgatagtggttgcgttgtgagctggaaaaacaaagaactgaaatgtggcagcgggatcttcatcacagataacgtgcacacatggacagaacaatacaagttccaaccagaatccccttcaaaattagcttcagctatccagaaagctcatgaagagggcatttgtgggattcgctcagtaacaagattggagaatctgatgtggaaacaaataacaccagaattgaaccacattctatcagaaaatgaggtaaagttgaccatcatgacaggagatattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagcaatggagtattagaaagtgagatgataattccaaaaagttttgctgggccagtgtcacaacacaactacagaccaggctattacacgcaaacagcaggaccttggcatctaggtaagcttgaaatggactttgatttctgcgaaggaactacagtggtggtgactgaggactgcggaaatagaggaccctctttaagaacgaccactgcctctggaaaacttataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttgggaatggcactattcttggaagaaatgctcaggacacgagtaggaacgaaacatgcaatactgctagttgcagtttcctttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtccttaaaatagtgagaaatatggaaaagtaccaattggcagtgactatcatggctatctcgtgtgtcccaaatgcagtgatattgcaaaacgcatggaaggtgagctgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaggctatcatggctgtcgggatggtgagcattttagccagttccctcttaaagaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatactcatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggctgaactggaagatggagcctatagaatcaagcagaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgtccaaacgaaacctggacttttcaaaaccaacaccggaaccataggcgccgtatctctggacttttctcctggaacgtcaggatctccaattgtcgacagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggacttccaataagataccaaaccccagccatcagagccgagcataccgggcgggagattgtggacctaatgtgtcatgccacgtttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccaatcatagatgaggaaagagaaatccctgagcgctcgtggaactctggacatgaatgggtcacggattttaaagggaagactgtttggtttgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggctggcctacagagtggcagctgaaggcatcaactacgcagacagaaggtggtgttttgatggagttaagaataaccaaatactggaagaaaacgtggaagtggaaatttggacaaaagagggggaaaggaagaaattaaaacccagatggttggacgctaggatctattctgacccactggcactaaaagaattcaaggaatttgcagctggaagaaagtccctaaccctgaacctaatcacagaaatgggtaggcttccaactttcatgactcaaaaagcaagagacgcactggataacctagctgtgctgcatacggctgaggcaggtggaagagcgtacaatcatgctctcagtgaactgccggagaccctggagacactgcttttactgacacttctggctacagtcacgggaggaatcttcttattcttaatgagcggaaaaggtgtagggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggttttctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttcccctccttgccattggatgttactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttgggacaagtaatgctcctaattctctgcgtgactcaagtattaatgatgaggactacatgggctctgtgtgaggctctaaccttagcgaccgggcccatctccacattgtgggaaggcaatccagggaggttttggaacactaccattgcagtgtcaatggctaacatttttagagggagctacttggctggagctggacttcttttttccatcatgaagaatacaacaaatacaagaagaggaactggcaacataggagagacgcttggagagaaatggaaaagccgattgaacgcactgggaaaaagtgaatttcagatttacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaggaacctatccccatgtcaacatatgggtggaatctagtacgtctgcagagtggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacactcaattttgcataaaggttctcaacccatacatgccctcagttatagaaaaaatggaaacactgcagaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagctacctacgagccagatgttgacctagggagcggaacccgcaacattggaattgaaagtgagataccaaatctagacataataggaaagagaatagagaaaataaagcaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacagatggcaatgacagatacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggggccatattcactgatgagaacaaatggaagtcggcacgcgaggctgttgaggatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacactagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagttacagaagaaatcgctgtacagaactggttggcaagagtggggcgtgaaaggctatcaagaatggccatcagtggagatgattgtgttgtaaaacctttagatgacagatttgcaagtgctttaacagctctaaatgacatgggaaaagttaggaaagacatacaacaatgggaaccttcaaaaggatggaacgattggacacaagtgcctttttgttcacaccattttcatgagttaatcatgaaagacggccgcgtgcttgtggttccatgcagaaaccaagatgaactgattggcagggcccgaatttcccagggagctgggtggtctttgaaggagacggcctgtttggggaagtcttacgcccaaatgtggagcctgatgtacttccacagacgtgacctcaggctggcggcaaatgctatttgctcggcagtcccgtcacattgggttcctacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7032 - RNA, 9876 nt, synthetic construct
  misc_feature 1..9876: note = derived and/or modified CDS sequence (wt) from DENV-2__FM210226__SS-prME
  source 1..9876: mol_type = other RNA
acagcaggcgtgattattatgttaattccaacagcgatggcgttccatttaaccacacgtaatggagaaccacacatgatcgttggcagacaagagaaagggaaaagtcttctgtttaaaacagaggatggtgtgaacatgtgtaccctcatggccattgatcttggtgaattgtgtgaagatacaatcacgtacaagtgccccctcctcaggcagaatgaaccagaagatatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggattttgagacatccaggctttaccataatggcagcaatcctggcatacaccgtaggaacgacacatttccaaagggccctgattttcatcttactggcagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaactgaagccaaacaacctgccactctaaggaagtactgtatagaggcaaagctgaccaatacaacaacagaatctcgttgcccaacacaaggggaacccagtctaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggccaaatgtttgagacaacaatgagaggagcaaagagaatggctattttaggtgacacagcctgggattttggatctctgggaggagtgtttacatctataggaaaggctctccaccaagttttcggagcaatctatggggccgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtaagctggaaaaacaaagaactgaaatgtggcagcgggatcttcatcacagataacgtgcatacgtggacagaacaatacaagttccaaccagaatccccttcaaaattagcttcagctatccaaaaagctcatgaagagggtatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatcccacaaccagacctttctcattgatggccctgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagttaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggacggatgctggtatgggatggaaatcagaccattaaaagagaaagaagagaatttggtcaactccctggtcacagccggacatgggcagattgacaacttttcactaggagtcttgggaatggcactattcctggaagaaatgctcaggacacgagtaggaacgaaacatgcaatactgctagttgcagtttcttttgtgacattgattactgggaacatgtcctttagagatttgggaagagtaatggttatggtgggcgctgccatgacggatgacataggtataggagtgacttatcttgccctactggcagctttcaaagtaagaccaacttttgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgaccatcatggccatctcgtgtgtcccaaatgcagtgatactgcaaaacgcatggaaggtgagctgcacaatattggcaacggtgtccgtttctccactgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttgaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcattggaacctgggaaaaatccaagagctgtccaaacgaaacctggacttttcaaaaccaacaccggaaccataggcgccgtatctttggacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagttgagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactatgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactagataacctagctgtgctgcatacggctgaggcaggtggaagggcgtacaatcatgctctcagtgaactgccggagacccttgagacactacttttactgacactcctggctacagtcacgggaggaattttcttattcttaatgagtggaaaaggtgtagggaagatgaccctgggaatgtgctgcataataacggctagcatcctcctatggcatgcacagatacaaccacactggatagcagcttcaataatattggagttttttctcatagttttgctcattccagagccagaaaaacagagaacaccccaagataaccaactgacctacgttgtcatagccatcctcacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggacatcggagttccccttcttgccattggatgctactcacaagtcaaccccataactctcacagcagctcttcttttactggtagcgcattatgccattatagggccaggacttcaagcgaaagcaactagagaagctcagaaaagagcagcagcaggcatcatgaaaaacccaacagtcgatggaataacagtgattgacctagatccaataccctatgatccaaaatttgaaaaacagctaggacaagtaatgctcctgattctctgcgtgactcaagtattaatgatgaggactacatgggctttgtgtgaggctctaaccttagcgaccgggcccatctccacattgtgggaaggtaatccagggaggttttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaaccagtccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcgtcagtgaacatgatctcaaggatgctgattaacagattcacaatgaaacacaagaaagccacctacgagccagatgttgacctagggagcggaacccgcaacattggaattgagagtgagataccaaatctagacataataggaaagagaatagagaaaataaaacaagagcatgaaacatcatggcactatgaccaggaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgtgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagctttgggggccatattcactgatgagaacaaatggaagtcggcacgcgaggctgttgaagatagtaggttttgggagctggttgacaaggaaagaaatctccatcttgaagggaagtgtgaaacatgtgtgtacaacatgatgggaaagagagaaaagaaactaggggagttcggcaaggcaaaaggtagcagagccatatggtacatgtggcttggagcacgcttcttggagtttgaagccttgggattcttgaatgaggatcactggttctccagagagaactccctgagtggagtggaaggagaagggctgcacaagctaggctacattctaagagatgtgagcaagaaggaaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggcacctatggccttaacactttcaccaatatggaagcccaactaattagacagatggagggagaaggaattttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccatttccatgagttaatcatgaaagacggtcgcgtgctcgtagttccatgcagaaaccaagatgaactgatcggcagggcccgaatttcccagggagctgggtggtctctgaaggagacggcctgtttggggaagtcttacgctcaaatgtggagtctgatgtacttccacagacgtgacctcaggctggcggcaaacgccatttgctcggcagtcccgtcacattgggttccaacaagtcgaacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7033 - RNA, 9876 nt, synthetic construct
  misc_feature 1..9876: note = derived and/or modified CDS sequence (wt) from DENV-2__FM210227__SS-prME
  source 1..9876: mol_type = other RNA
acagcaggcgtaattattatgttgattccaacagcgatggcgttccatctaaccacacgtaatggagaaccacacatgatcgttggtagacaagagaaagggaaaagtctcctgttcaaaacagaggatggtgtgaacatgtgtacccttatggccatagatcttggtgaattgtgtgaagatacaatcacgtacaagtgccccctcctcaggcagaatgaaccagaagacatagattgttggtgtaactctacgtccacatgggtaacctatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgattttcatcttattgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattgtttggaaagggaggcatcgtgacctgtgctatgtttacatgcaaaaagaacatggaaggaaaaatcgtgcaaccagaaaatctggaatacaccatcgtgataacacctcactcaggagaagagcacgctgtaggtaatgacacaggaaaacatggtaaggaaatcaaaataacaccacagagttccgtcacagaagcagaactgacaggctatggcacagtcacgatggagtgctctccgagaacgggccttgattttaatgagatggtgctgctacagatggaagacaaggcttggctggtgcacaggcaatggttcctagacctgccgttaccatggctacccggagcggacacacaaggatcaaattggatacagaaagagacactggtcactttcaaaaatccccacgcgaagaaacaggatgtcgttgtcttaggatctcaagaaggggccatgcacacggcactcacaggggccacagaaatccagatgtcatcaggaaacttactattcacaggacatctcaagtgcaggctgagaatggacaaactacagctcaaaggaatgtcatattctatgtgcacaggaaagtttaaaattgtgaaggaaatagcagaaacacaacatggaacaatagttattagagtacaatatgaaggagacggctctccatgtaagatcccttttgaaataatggatttagaaaaaagacatgtcttaggtcgcctgattacagttaacccgatcgtaacagagaaagatagcccagtcaacatagaagcagaacctccattcggagacagctacatcattataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaagctctccaccaggtcttcggagcaatctatggagctgcctttagtggggtctcatggactatgaaaatcctcataggagccatcatcacatggataggaatgaattcacgtagcacctcactgtctgtgtcactagtattagtgggagtcataacactgtacttgggagccatggtgcaggctgatagtggctgcgttgtgagctggaaaaacaaagaactgaaatgtggcagcgggatcttcatcacagataacgtgcacacatggacagaacaatacaagttccaaccagaatccccttcaaaattagcttcagctatccaaaaagctcatgaagagggcatttgtggaattcgctcagtaacaagattggagaatctgatgtggaaacaaataacaccagaattgaatcacattctatcagaaaatgaggtaaagttgaccatcatgacaggagacattaaaggaatcatgcaggcaggaaaaagatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtacactcaatgacacatggaagatggaaaaggcctccttcattgaagttaaaagctgccactggccaaagtcacacaccctctggagtaatggagtattagaaagtgagatgataattccaaaaagttttgctgggccagtgtcacaacacaactacagaccaggctatcacacgcaaacagcaggaccttggcatctaggtaagcttgaaatggactttgatttctgcgaaggaactacagtggtggtgactgaggactgcggaaatagaggaccctctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttggggatggcactattcctggaagaaatgctcaggacacgagtaggaacgaaacatgcaatactgctagttgcagtttcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatgatccttaaaatagtgagaaatatggaaaagtaccaattggcagtgactatcatggccatctcgtgtgtcccaaatgcagtgatactgcaaaacgcatggaaggtgagctgcacaatattggcagcggtgtccgtttctccactgctcttaacatcctcacagcaaaaagcggattggataccattggcgttgacgataaaaggtctcaatccaacagccatttttctaacaactctttcgagaaccagcaagaaaaggagctggccgctaaatgaggccatcatggcagtcgggatggtgagcattttagccagttctctcttaaagaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatacttatcagaacgggattgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgtccaaacgaaacctggacttttcaaaaccaacaccggaaccataggtgccgtatctctggacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagattgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggactcccaataagataccaaaccccagccatcagagccgagcataccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccaggaagtagagacccatttcctcagagcaatgcaccaatcatggatgaggaaagagaaatccctgagcgctcgtggaactttggacatgaatgggtcacggattttaaagggaagactgtttggtttgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaagtggatgccattgatggtgaataccgcttgagaggagaagcaaggaaaacctttgtggacctaatgagaagaggggacttaccagtctggttggcatacagagtggcagctgaaggcatcaactacgcagacagaaggtggtgttttgatggagttaagaataaccaaatactggaagaaaacgtggaagtggaaatttggacaaaagaaggggaaaggaagaaattaaaacccagatggttggacgctaggatctattctgacccactggcactaaaagaattcaaggaatttgcagctggaagaaagtccctaaccctgaacctaatcacagaaatgggtaggcttccgactttcatgactcaaaaggcaagagacgcactggataacctagctgtgctgcatacggctgaggcaggtggaagagcgtacaatcatgctctcagtgaactgccggagaccctggagacactgcttttactgacactcctggctacagtcacgggaggaatcttcctattcttaatgagcggaaaaggtgtagggaagatgaccctgggaatgtgctgcataatcacagctagcatcctcctatggtatgcacagatacaaccacactggatagccgcttcaataatactggagttttttctcatagttttgctcattccagaaccagaaaaacagagaacaccccaagataaccaattgacctacgttgtcatagccatcctcacagtagtggccgcaactatggcaaacgaaatgggtttcctggaaaaaaccaagaaagacctcggattgggaagtgttgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggatatcggagttcccctccttgccattggatgttactcacaagttaaccccattactctcacagcagctcttcttttattggtagcacattatgccattatagggccaggacttcaagcgaaagcaaccagagaagctcagaaaagagcagcagcaggcatcatgaaaaacccaacagtcgatggaataacagtgatcgacctagatccaataccctatgatccgaaatttgaaaaacagttgggacaagtaatgctcctaattctctgcgtgactcaagtattaatgatgaggactacatgggctctgtgtgaggctctaaccttagcgaccgggcccatctccacattgtgggaaggtaatccagggaggttttggaacactaccattgcagtgtcaatggccaacatttttagagggagctacttggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcggcaaagctgaggtggttcgtcgagagaaatatggtcacaccagaagggaaagtggtggacctcggctgtggcagagggggctggtcatactattgtgggggactaaagaatgtaagagaagtcaaaggcctgacaaaaggaggaccaggacacgaagaacctatccccatgtcaacatatggatggaatctagtacgtctgcagagtggagttgatgtttttttcactccgccagaaaagtgtgacacactgttgtgtgacataggggagtcgtcaccaaatcccacgatagaagcaggacgaacactcagagtcctcagcttggtggaaaattggttgaacaatgacacccaattttgcataaaggttctcaacccatacatgccctcagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagctacctacgagccagatgttgacctagggagcggaacccgcaacattggaattgaaagtgagataccaaatctagacataataggaaagagaatagagaaaataaaacaagagcatgaaacatcatggcactatgaccaagaccatccatataaaacatgggcttaccatggcagctatgaaacaaaacagactggatcagcatcatccatggtgaacggagtggtcagactactgacaaaaccttgggacgtcgtccctatggtaacacaaatggcaatgacagatacgactccattcggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgaggagcaatgcagcattgggggccatattcactgatgagaacaaatggaaatcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagtagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacattagaggacttaaaaaatgaagaaatggtgacaaaccacatgggaggagaacacaagagactagccgaggccatatttaaattaacgtaccaaaacaaggtggtgcgtgtgcaaagaccaacaccaagaggcacagtaatggatatcatatcgagaagagaccaaagaggtagtgggcaagttggcacctatggccttaacactttcaccaatatggaagcccaattaattagacagatggagggagaaggaattttcaaaagcattcagcacctgacagtcacagaagaaatcgctgtacagaactggttagcaagagtggggcgtgaaaggctatcaagaatggccatcagtggggatgattgtgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgatttaatcatgaaagacggccgtgtgctcgtggttccatgcagaaaccaagatgaactgattggcagggcccgaatttcccagggagctgggtggtctttgaaggagacggcctgtttggggaagtcttatgcccaaatgtggagcctgatgtacttccacagacgtgacctcaggctggcggcaaatgccatttgctcagcagtcccgtcacattgggttccaacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 7034 - RNA, 9876 nt, synthetic construct
  misc_feature 1..9876: note = derived and/or modified CDS sequence (wt) from DENV-2__FM210204__SS-prME
  source 1..9876: mol_type = other RNA
acagcaggcgtaattattatgttgattccaacagcgatggcgttccatctaaccacacgtaatggagaaccacacatgatcgttggtagacaagagaaagggaaaagtcttctgttcaaaacagaggatggtgtgaacatgtgtacccttatggccatagaccttggtgaattgtgtgaagatacaatcacgtacaagtgccccctcctcaggcagaatgaaccagaagacatagattgttggtgtaactctacgtccacatgggtaacctatgggacgtgcaccaccacaggagaacacagaagagaaaaaagatcagtggcactcgttccacatgtgggtatgggactggagacacgaactgaaacatggatgtcgtcagaaggagcctggaaacacgctcagagaattgaaacctggatcttgagacatccaggctttaccataatggcagcaatcctggcatacaccataggaacgacacatttccaaagggccctgatttttatcttattgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaacaacctgccactctaaggaagtactgtatagaagcaaagctgaccaacacaacaacagaatctcgttgcccaacacaaggggaacccagtctaaatgaagagcaggacaaaaggttcgtctgcaaacactccatggtggacagaggatggggaaatggatgtggattgtttggaaagggaggcatcgtgacctgtgctatgtttacatgcaaaaagaacatggaaggaaaaatcgtgcaaccagaaaatctggaatacaccatcgtgataacacctcactcaggagaagagcacgctgtaggtaatgacacaggaaaacatggtaaggaaatcaaaataacaccacagagttccgtcacagaagcagaactgacaggctatggcacagtcacgatggagtgctctccgagaacgggccttgattttaatgagatggtgctgctacagatggaagacaaagcttggctggtgcacaggcaatggttcctagacctgccgttaccatggctacccggagcggacacacaaggatcaaattggatacagaaagagacactggtcactttcaaaaatccccacgcgaagaaacaggatgtcgttgtcttaggatctcaagaaggggccatgcacacggcactcacaggggccacagaaatccagatgtcatcaggaaacttactattcacaggacatctcaagtgcaggctgagaatggacaaactacagctcaaaggaatgtcatactctatgtgcacaggaaagtttaaaattgtgaaggaaatagcagaaacacaacatggaacaatagttattagagtacaatatgaaggagacggctctccatgtaagatcccttttgaaataatggatttagaaaaaagacatgtcttaggtcgcctgattacagttaacccgatcgtaacagagaaagatagcccagtcaacatagaagcagaacctccattcggagacagctacatcattataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaagctctccaccaagtcttcggagcaatctatggagctgcctttagtggggtctcatggactatgaaaatcctcataggagccatcatcacatggataggaatgaattcacgtagcacctcactgtctgtgtcactagtattagtgggagtcataacactgtacttgggggccatggtgcaggctgatagtggctgcgttgtgagctggaaaaacaaagaactgaaatgtggcagtgggatcttcatcacagataacgtgcacacatggacagaacaatacaagttccaaccagaatccccttcaaaattagcttcagctatccaaaaagcttatgaagagggcatttgtggaattcgctcagtaacaagattggagaatctgatgtggaaacaaataacgccagaattgaatcacattctatcagaaaatgaggtaaagttgaccatcatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggcctcgaaacagcagaatgccccaacacaaacagagcttggaactcgctggaagttgaagactatggctttggagttttcaccaccaacatatggctaaaattgagagaaaaacaggatgtgttttgtgactcaaaactcatgtcagcagccataaaagacaacagagccgtccatgccgatatgggttactggatagaaagtgcactcaatgacacatggaagatggaaaaggcctccttcattgaagttaaaagctgccactggccaaagtcacacaccctctggagtaatggagtattagaaagtgagatgataattccaaaaagttttgctgggccagtgtcacaacacaactacagaccaggctatcacacgcaaacagcaggaccttggcatctaggtaagcttgaaatggactttgatttctgcgaaggaactacagtggtggtgactgaggactgcggaaatagaggaccctctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagcaggacatgggcagattgacaacttctcactaggagtcttggggatggcactattcctggaagaaatgctcaggacacgagtaggaacgaaacacgcaatactgctagttgcagtttcttttgtgacattgattactgggaacatgtcctttaaagacctgggaagagtgatggttatggtgggcgctaccatgacggatgacataggtatgggagtgacttatcttgccctactagcagctttcaaagttagaccaacttttgcagctggactactactgagaaagctgacctccaaggaattaatgatggctaccataggaattgcactcctttctcaaagcaccataccagagaccattcttgaactaactgatgcgttagccttgggcatgatggtccttaaaatagtgagaaatatggaaaagtaccaattggcagtgactatcatggctatctcgtgtgtcccaaatgcagtgatattgcaaaacgcatggaaggtgagctgcacaatactggcagcggtgtccgtttctccactgctcttaacatcctcacagcagaaagcggattggataccactggcgttgacgataaaaggtctcaatccaacagccatttttctaacaactctttcgagaaccagcaagaaaaggagctggccgctaaatgaggctatcatggcagtcgggatggtgagcattttagccagttctctcttaaagaatgacattcccatgacaggtccattagtggctggagggctccttactgtgtgctacgtgctcactggacgatcggccgatttggaactggagagagccaccgatgtcaaatgggaagatcaggcagaaatatcaggaagcagcccaatcctgtcaataacaatatcagaagatggcagcatgtcgataaagaatgaagaggaagaacaaacactgaccatacttatcagaacgggattgctagtgatctcaggactctttccagtgtcaataccaattacggcagcagcatggtacctgtgggaagtgaagaaacaaagggctggagtattgtgggacgtcccttcacccccacccgtgggaaaggccgaactggaagatggagcctatagaatcaagcaaaaagggattcttggatactcccagatcggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaaactcgaaggagaatggaaggaaggagaggaagtccaagtcctggcattggaacctggaaaaaatccaagagctgtccaaacgaaacctggacttttcaaaaccaacaccggaaccataggtgccgtatctctggacttttcccctggaacgtcaggatctccaattgtcgatagaaaaggaaaagttgtgggtctttatggcaatggtgttgtcacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttaagaacattaatcctggcccccactagagtcgtggcagctgaaatggaggaagctcttagaggactcccaataagataccaaaccccagccatcagagccgagcataccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaggcagctgggattttcatgacagccactcctccaggaagtagagacccatttcctcagagcaatgcaccaatcatggatgaggaaagagaaatccctgagcgctcgtggaactctggacatgaatgggtcacggattttaaagggaagactgtttggtttgttccaagtataaaagcgggaaatgacatagcagcttgtctcagaaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaaaccagttatactaacagatggtgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcgcattggaaagaagctaaaatgctcctagataacatcaacacacctgaaggaatcattcctagtatgttcgaaccagagcgtgaaaaggtggatgccattgatggtgaataccgcttgagaggagaagcaaggaaaacctttgtggacctaatgagaagaggggacttaccagtctggttggcctacagagtggcagctgaaggcatcaactacgcagacagaaggtggtgttttgatggagttaagaataaccaaatactggaagaaaacgtggaagtggaaatttggacaaaagaaggggaaaggaagaaattaaaacccagatggttggacgctaggatctattctgacccactggcactaaaagaattcaaagaatttgcagctggaagaaagtccctaaccctgaacctaatcacagaaatgggtaggcttccgactttcatgacccaaaaggcaagagacgcactggataacctagctgtgctgcatacggctgaggcaggtggaagagcgtacaatcatgctctcagtgaactgccggagaccctggagacactgcttttactgacactcctggctacagtcacgggaggaatcttcctattcttaatgagcggaaaaggtgtagggaagatgaccctgggaatgtgctgcataatcacggctagcatcctcctatggtatgcacagatacaaccacactggatagccgcttcaataatattggagttttttctcatagttttgctcattccagaaccagaaaaacagagaacaccccaagataaccaattgacctacgttgtcatagccatcctcacagtagtggccgcaaccatggcaaacgaaatgggtttcctggaaaaaaccaagaaagacctcggattgggaagtgttgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattgtcaaagatggatatcggagttcccctccttgccattggatgttactcacaagttaaccccattactctcacagcagctcttcttttattggtagcacattatgccattatagggccaggacttcaagcgaaagcaaccagagaagctcagaaaagagcagcagcaggcatcatgaaaaacccaacagtcgatggaataacagtgatcgacctagatccaataccctatgatccaaaatttgaaaaacagttgggacaagtaatgctcctaattctctgcgtgactcaagtattaatgatgaggactacatgggctctgtgtgaggctctaaccttagcgaccgggcccatctccacattgtgggaaggtaatccagggaggttttggaacactaccattgcagtgtcaatggccaacatttttagagggagctacctggctggagctggacttcttttttccatcatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcggcaaagctgaggtggttcgtcgagagaaatatggtcacaccagaagggaaagtggtggacctcggctgtggcagagggggctggtcatactattgtgggggactaaagaatgtaagagaagtcaaaggcctgacaaaaggaggaccaggacacgaagaacctatccccatgtcaacatatggatggaatctagtacgtctgcagagcggagttgatgttttcttcactccgccagaaaagtgtgacacactgttgtgtgacataggggagtcgtcaccaaatcccacgatagaagcaggacgaacactcagagtcctcagcttggtggaaaattggttgaacaatgacacccaattttgcataaaggttctcaacccatacatgcccccagttatagaaaaaatggaaacactgcaaaggaaatatggaggagccttagtgaggaatccactctcacgaaactccacacatgagatgtactgggtatccaatgctactgggaacatagtgtcatcagtgaacatgatttcaaggatgctgattaacagattcacaatgaaacacaagaaagctacctacgagccagatgttgacctagggagcggaacccgcaacattggaattgaaagtgagataccaaatctagacataataggaaagagaatagagaaaataaaacaagagcatgaaacatcatggcactatgaccaagaccacccatataaaacatgggcttaccatggcagctatgaaacaaaacagactggatcagcatcatccatggtgaacggagtggtcagactactgacaaaaccttgggacgtcgtccctatggtaacacaaatggcaatgacagatacgactccattcggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgaggagcaatgcagcattgggggccatattcactgatgagaacaaatggaaatcggcacgcgaggctgttgaagatagtaggttttgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcttggagtttgaagccctgggattcttgaatgaagatcactggttctctagagagaactccctgagtggagtggaaggagaagggctgcacaagctaggctacattctaagagacgtgagcaagaaggaaggaggagcaatgtacgccgatgatacagcaggatgggacacaagaatcacattagaggacttaaaaaatgaagaaatggtgacaaaccacatggaaggagaacacaagagactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccagttaattagacagatggagggagaaggaattttcaaaagcattcagcacctgacagtcacagaagaaatcgctgtacagaactggttagcaagagtggggcgtgaaaggctatcaagaatggccatcagtggggatgattgcgttgtaaaacctttagatgacagatttgcaagtgctttaacagctctaaatgacatgggaaaagttaggaaagacatacaacaatgggaaccttcaaaaggatggaacgattggacacaagtgcctttctgttcacaccattttcatgatttaatcatgaaagacggccgtgtgctcgtagttccatgcagaaaccaagatgaactgattggcagggcccgaatttcccagggagctgggtggtctttgaaggagacggcctgtttggggaagtcttatgcccaaatgtggagcctgatgtacttccacagacgtgacctcaggctggcggcaaatgccatttgctcggcagtcccgtcacattgggttccaacaagtcgaacaacctggtctatacacgccaaacatgaatggatgacgacggaagacatgctgacagtctggaacagggtgtggatccaagaaaacccatggatggaagacaaaactccagtggagtcatgggaggaagtcccatatttgggaaaaagagaagaccaatggtgcggctcattgattgggctaacaagcagggctacctgggcaaagaacatccaaacagcaataaatcaagtcagatcccttataggcaatgaagaatacacagattacatgccatccatgaagagattcagaagggaagaggaagaggcaggtgtcctgtggtag

SEQ ID NO: 7035 - RNA, 9876 nt, synthetic construct
  misc_feature 1..9876: note = derived and/or modified CDS sequence (wt) from DENV-2__FM210230__SS-prME
  source 1..9876: mol_type = other RNA
acagcaggcgtgattattatgttaattccaacagcgatggcgttccatttaaccacacgaaatggagaaccacacatgatcgttggcagacaagagaaagggaaaagtcttctgtttaaaacagaggatggtgtgaacatgtgtaccctcatggccattgaccttggtgaattgtgtgaagatacaatcacgtacaagtgccccctcctcaggcagaatgaaccagaagacatagattgttggtgcaactccacgtccacatgggtaacttatgggacgtgtaccaccacaggagaacacagaagagaaaaaagatcagtggcactcgttccacatgtgggtatgggactggagacacgaactgaaacatggatgtcgtcagaaggggcctggaaacacgctcagagaattgaaacctggatcttgagacatccaggctttaccataatggcagcaattctggcatacaccgtaggaacgacacatttccaaagggccctgattttcatcttattggcagctgtcgctccttcaatgacaatgcgttgcataggaatatcaaatagagactttgtagaaggggtttcaggaggaagctgggttgacatagtcttagaacatggaagttgtgtgacgacaatggcaaaaaataaaccaacactggattttgaactgataaaaacagaagccaaacaacctgccactctaaggaagtactgtatagaggcaaagctgaccaatacaacaacagaatctcgttgcccaacacagggggaacccagtttaaatgaagagcaggacaaaaggttcgtctgcaaacactccatggtagacagaggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggcaaggaaattaaaataacaccacagagtcccatcacagaagcagaactgacaggctatggcacagtcacgatggagtgctctccgagaacgggccttgacttcaatgagatggtgctgctgcagatggaagataaagcttggctggtgcacaggcaatggttcctagacctgccgttaccatggctacccggagcggacacacaaggatcaaattggatacagaaagagacattggtcactttcaaaaatccccacgcgaagaagcaggatgtcgttgttttaggatctcaagaaggggccatgcacacggcactcacaggggccacagaaatccagatgtcatcaggaaacttactattcacaggacatctcaaatgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaatccgatcgtaacagaaaaagatagcccagtcaacatagaagcagaacctccattcggagacagctacatcattataggagtagagccgggacaattgaaactcaactggttcaagaaaggaagttccatcggacaaatgtttgagacaacaatgagaggagcaaagagaatggccattttaggtgacacagcctgggattttggatctctgggaggagtgtttacatctataggaaaggctctccaccaagttttcggagcaatctatggggctgcctttagtggggtttcatggactatgaaaatcctcataggagtcatcatcacatggataggaatgaattcacgtagcacctcactgtctgtgtcactagtattggtgggagtcataacactgtacttgggagctatggtgcaggctgatagtggttgcgttgtgagctggaaaaacaaagaactgaaatgtggcagcgggatcttcatcacagataacgtgcacacgtggacagaacaatacaagttccaaccagaatccccttcaaaattagcttcagccatccaaaaagctcatgaagagggcatttgtggaatccgctcagtaacaagattggagaatctgatgtggaaacaaataacaccagaattgaatcacattctatcagaaaatgaggtaaagttgaccattatgacaggagacattaaaggaatcatgcaggcaggaaaacgatctctgcggccccagcccactgagctgaagtattcatggaaaacatggggaaaggcgaaaatgctctccacagaatctcacaaccagacctttctcattgatggccccgaaacagcagaatgccccaacacaaacagagcttggaactcgctggaagttgaagactatggttttggagttttcaccaccaatatatggctaaaattgagagaaaaacaggatgtgttctgtgactcaaaactcatgtcagcagccataaaagacaacagagccgtccatgccgatatgggctattggatagaaagtgcactcaatgacacatggaagatggagaaggcctctttcattgaagtcaaaagctgccactggccaaagtcacacaccctctggagtaatggagtattagaaagtgagatgataattccaaaaagttttgctgggccagtgtcacaacacaattacagaccaggctattacacgcaaacagcaggaccttggcatctaggtaagcttgagatggactttgatttctgcgaaggaactacagtggtggtgactgaggactgcggaaatagaggaccatctttaagaacgaccactgcctctggaaaactcataacagaatggtgctgccgatcctgcacattaccacctctaagatacagaggtgaggatggatgctggtatgggatggaaatcagaccattaaaagagaaagaagagaatttggtcaactccttggtcacagccggacatgggcagattgacaacttttcactaggagtcttgggaatggcattatttctggaagaaatgctcaggacacgagtaggaacgaaacatgcaatactgctagttacagtttcttttgtgacattgattactgggaacatgtcctttagagatctgggaagagtgatggttatggtgggcgctgccatgacggatgacataggtatgggagtgacttatcttgccctactggcagctttcaaagtaagaccaacttttgcagctggactactactgagaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtaccaattggcagtgactatcatggccatctcgtgtgtcccaaatgcagtgatattgcaaaacgcatggaaggtgagctgcacaatattggcagcggtgtccgtttctccaatgctcttaacatcctcacagcagaaagcggattggataccactggcattgacgataaaaggtctcaatccaacagccatttttctaacaaccctttcgagaactagcaagaaaaggagctggccgctaaatgaggccatcatggcagtcgggatggttagtattttagccagttctctcttaaagaatgacattcccatgacaggtccattagtggctggagggctccttactgtgtgttacgtgctcactggacgatcggccgatttggaactggagagagccaccgatgtcaaatgggaagatcaggcagaaatatcaggaagcagcccaatcctgtcaataacaatagcagaagatggcagcatgtcgataaaaaatgaagaggaagaacaaacactgactatactcatcagaacgggactgctagtgatctcaggactctttccagtgtcaataccaattacggcagcagcatggtacctgtgggaagtgaagaaacaacgggctggagtattgtgggacgtcccttcacccccacccgtgggaaaggccgaactggaagatggagcctatagaatcaagcaaaaagggattcttggatactcccagattggagctggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaggtccaagtcctggcattggaacctgggaagaatccaagagctgtccaaacgaaacctggacttttcaaaaccaacaccggaaccataggcgccgtatctttggacttttcccctggaacatcaggatctccaattgtcgatagaaaaggaaaagttgtgggtctttatggcaatggtgttgttacaaggagtggagcatacgtgagtgctatagcccagaccgaaaaaagcattgaagacaatccagagatcgaagatgacattttccgaaagaaaagattgactatcatggacctccatccaggagcgggaaagacaaaaagataccttccagccatagttagagaggccataaaacgtggcttgagaacattaatcctggcccccactagagttgtggcagctgaaatggaggaagcccttagaggacttccaataagataccaaaccccagccatcagagccgagcacaccgggcgggagattgtggacctaatgtgtcatgccacatttactatgaggctgctatcaccagtcagagtgccaaattacaacctgatcatcatggatgaagctcacttcacagacccagcaagtatagcagctagaggatacatttcaactcgagtagagatgggtgaagcagctgggattttcatgacagccactcctccgggaagtagagacccatttcctcagagcaatgcaccgatcatggatgaggaaagagaaatccctgagcgttcgtggaactctggacatgaatgggtcacggattttaaagggaagactgtttggttcgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccctagacgctgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaaggaagacctttgtggacctaatgagaagaggggacttaccagtctggttggcttacagagtggcagctgaaggcatcaactacgcagacagaaggtggtgttttgatggagttaagaacaaccaaatactagaagaaaacgtggaagtggaaatttggacaaaagaaggggaaaggaagaaattaaaacccagatggttggatgctaggatctattctgacccactggcactaaaagaattcaaggaatttgcggctggaagaaagtccttgaccctgaacctaatcacagaaatgggtagacttccaactttcatgacccagaaggcaagagacgcactggataacctagctgtgctgcatacggctgaggcaggtggaagggcgtacaatcatgctctcagtgaactgccggagaccctggagacactacttttactgacactcctggctacagtcacgggaggaattttcttattcttaatgagcggaaaaggtgtagggaagatgaccctgggaatgtgctgcataatcacggctagcatcctcctatggtatgcacagatacaaccacactggatagcagcttcaataatattggagttttttctcatagttttgctcattccagaaccagaaaaacagagaacaccccaagataaccaactgacctacgttgttatagccatcctcacagtggtggccgcaaccatggcaaacgagatgggtttcctagaaaaaaccaagaaagacctcggattgggaagcattgcaacccaggaacctgagagcaacatcctggacatagatctacgtcctgcgtcagcatggacgctgtatgccgtggctacaacatttgtcacaccaatgttgagacatagcattgaaaattcctcagtgaatgtgtccctaacagccattgctaaccaagccacagtgctaatgggtcttgggaaaggatggccattatcaaagatggacatcggagttccccttcttgccattggatgctactcacaagtcaaccccataactctcacagcagctcttcttttactggtagcgcattatgccattatagggccaggactccaagcgaaagcaaccagagaagctcagaaaagagcagcagcaggcatcatgaaaaacccaacagtcgatggagtaacagtgattgacctagatccaataccctatgatccaaaatttgaaaaacagctaggacaagtaatgctcctgattctctgcgtgactcaagtactaatgatgaggactacatgggctttgtgtgaggctctaaccttagcgaccgggcccatctccacattgtgggaaggtaatccagggagattttggaacactactattgcagtgtcaatggctaacatttttagagggagctacttggctggagctggacttcttttttccatcatgaagaacacaacaaatacaagaagaggaactggcaacataggagagacgcttggagagaaatggaaaagccgattaaacgcactggggaaaagtgaatttcagatctacaagaaaagtggaatccaggaagtggatagaaccttagcaaaagaaggcatcaaaagaggagaaacggaccaccacgctgtgtcgcgaggttcagcaaaactgagatggttcgtcgagagaaacatggtcacaccagaagggaaagtggtggaccttggttgcggcagagggggctggtcatactattgtgggggactaaaggatgtaagagaagtcaaaggcctgacaaaaggaggaccaggacacgaagaaccaatccccatgtcaacatatgggtggaatctagtacgcctgcagagtggagttgatgttttcttcactccgccagaaaagtgtgatacattgttgtgtgacataggggagtcgtcaccaaatcccacgatagaagcaggacgaacactcagagtccttagcttggtggaaaactggttgaacaatgacacccaattttgcataaaggttctcaacccatatatgccctcagtcatagaaaaaatggaaacactgcaaaggaaatatggaggagccttagtgaggaatccactctcacgaaactccacacatgagatgtactgggtatccaatgctactgggaacatagtgtcatcagtgaacatgatctcaaggatgctgattaacagattcacaatgaaacacaagaaagccacctacgagccagatgttgacttagggagcggaacccgcaacattggaattgaaagtgagataccaaatctagacataataggaaagagaatagagaaaataaaacaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccgtttggacaacagcgcgttttcaaagagaaagtggacacgagaacccaagaaccgaaggaaggcacaaagaaactgatgaaaatcacggcagagtggctttggaaagaactaggaaagaaaaagacacccaggatatgtaccagagaagaattcacaagaaaggtgagaagcaatgcagccttgggggccatattcactgatgagaacaaatggaagtcggcacgcgaggctgttgaagatagcaggttttgggagctggttgacaaggaaagaaatctccatcttgaagggaagtgtgaaacatgtgtgtacaacatgatgggaaagagagaaaagaaactaggggagttcggtaaggcaaagggtagcagagccatatggtacatgtggcttggagcacgcttcttggagtttgaagccttgggattcttgaatgaagatcactggttctccagagagaactccctgagtggagtggaaggagaagggctgcacaagctaggctacattctaagagatgtgagcaagaagggaggaggagcaatgtacgccgatgatacagcaggatgggacacaagaatcacactagaagacttaaaaaatgaagaaatggtgacaaaccacatggaaggagaacacaagaaactagccgaggccatttttaaattaacgtaccaaaacaaggtggtgcgtgtgcaaagaccaacaccaagaggcacagtaatggatatcatatcgaggagagaccaaagaggcagtgggcaagtcggtacctatggcctcaacactttcaccaatatggaagcccaattaattagacagatggagggagaaggagttttcaaaagcattcagcgcctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctgaatgacatgggaaaagtcaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgattggcagggcccgaatttcccagggagctgggtggtctttgaaggagacggcctgtttggggaagtcctacgctcaaatgtggagtctgatgtacttccacagacgtgacctcaggctggcggcaaatgctatttgctcggcagtcccgtcacattgggtcccaacaagtcgcacaacctggtctatacacgccaagcatgaatggatgacgacggaagacatgctgacagtctggaacagggtgtggatccaagaaaacccttggatggaagacaaaactccagtggagtcatgggaggaagtcccatatttggggaaaagagaagaccaatggtgcggctcattgattgggctaacaagcagggctacctgggcaaagaacatccaaacagcaataaatcaagtcagatcccttataggcaatgaggaatacacagattacatgccatccatgaagagattcagaagggaagaggaagaggcaggtgtcctgtggtag

SEQ ID NO: 7036 - RNA, 9876 nt, synthetic construct
  misc_feature 1..9876: note = derived and/or modified CDS sequence (wt) from DENV-2__KC762665__SS-prME
  source 1..9876: mol_type = other RNA
actgcaggtataattatcatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaattgaaacttgggtcttgagacatccaggcttcaccataatggcagcaatcctggcatataccataggaacaacatatttccaaagagtcctgattttcattttactgacagccgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcccgccactctaaggaagtattgtatagaggcaaagctgaccaacacaacaacagcatctcgctgcccaacacaaggagagcctagcctaaacgaagaacaggacaaaaggttcgtctgcaaacactccatggtagacagaggatggggaaatggatgcggattatttggaaagggaggcatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttactgtttacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgttttaggtcgcttgattacagtcaacccaattgtcacagaaaaagatagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtcttcggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgtgagttggaaaaacaaagaactgaaatgtggcagtgggatttttatcacagacaacgtgcacacatggacagaacaatacaaattccaaccagaatccccttcaaagctggcttcagccatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtattcaccactaacatatggctgaaattgaaagaaaggcaggatgcattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggattgtggaaatagaggaccctccttaagaacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcacactcctctctcagagtaccataccagagactatacttgaactgactgacgcgttggctttggggatgatggttctcaaaatagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccacttgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttcctgtgtcaataccaatcacagcagctgcatggtacctgtgggaagtgaaaaaacaacgggcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagccatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagctacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgttttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtagactcccaaccttcatgacccagaaagcaaggaatgcactggacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaaaggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagctacctggccggagccggacttctcttttctatcatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggttgcaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacactttgctgtgtgacataggggagtcgtcaccaaaccctacggttgaggcaggacgaacactcagagttctaaacttagtggaaaattggctgaataacaacacccaattttgcataaaggttctcaacccatacatgccctcagttatagaaaaaatggaagcgctacaaaggaaatatggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacaaatggcaatgacagacacgactccatttggacaacagcgcgtcttcaaagagaaagtggacacaagaacccaagaaccgaaagaaggcacaaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagctctaggattcctgaatgaagatcactggttttccagagagaactccctgagtggagtggaaggagaaggactgcacaaactaggctacattttaagagacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcaactgacagtcacagaagaaattgcagtgaaaaactggttagtgagagtggggcgtgagaggttatcaagaatggctatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttgggaaagtcctacgcccaaatgtggagcctgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaataaatcaagtcagatccctaataggcaatgaggaatacacagactacatgccatccatgaaaagattcagaagagaagaggaagaggcaggagtcttgtggtag

SEQ ID NO: 7037 - RNA, 9876 nt, synthetic construct
  misc_feature 1..9876: note = derived and/or modified CDS sequence (wt) from DENV-2__KC762669__SS-prME
  source 1..9876: mol_type = other RNA
actgcaggtataatcattatggtgattccaacagtgatggcgttccatttaaccacacgcaacggagaaccacacatgatcgtcagtagacaagagaaagggaaaagtcttctgtttaaaacagagaacggtgtgaacatgtgcaccctcatggccatggaccttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacaaagaattgagacttgggtcttgagacatccaggcttcaccataatggcagcaatcctggcatacaccataggaacgacatacttccaaagagtcctgattttcatcttactgacagctgtcgctccttcaatgacaatgcgttgcataggaatatcaaatagagactttgtggaaggggtttcaggaggaagctgggttgacatagttttggaacatggaagctgtgtgacgacgatggcgaaaaataaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggagggaaaaatcgtgcagccagaaaacctggagtacaccattgtgataacacctcactcaggggaagagaatgcagtcggaaatgacacaggaaaacacggcaaggaaattaaagtaacaccacagagttccatcacagaagcagaactaacaggctatggcactgttacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccacgcaaagaaacaggatgttgttgttttaggatcccaagaaggggctatgcacacagcactcacaggggccacggaaatccagatgtcatcaggaaacttactgttcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggccgcttgattacagtcaacccaattgtcacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggaccatgaaaatcctcataggagttgttattacatggataggaatgaattcacgcagcacctcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcacacatggacagaacaatacaaatttcaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagactatggctttggagtattcaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactaccgcttctggaaaactcataacagaatggtgctgccgatcttgcacattaccaccgctaaggtacagaggtgaggatggatgctggtatggaatggaaatcagaccattgaaggagaaagaagagaatttggtcaactctttggttacagccggacatggacagattgacaacttctcactaggagtcttgggaatggcattgttcctggaagagatgctcagaacccgagtaggaacgaaacatgcaatattactagttgcagtctctttcgtgacattgatcacagggaacatgtcctttcgagatttggggagagtgatggtcatggtaggcgctactatgacggatgacataggcatgggcgtgacttatcttgccctattagcagccttcaaggtcagaccaacttttgcagctggactactcttaagaaagctgacctccaaagaattgatgatgaccaccataggaatcgtactcctctctcagagcaccataccagagactatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagtaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactagagagagctgctgacgtaagatgggaagaacaggcagagatatcaggaagcagtccaattctgtcgataacaatatcggaagatggtagcatgtcgataaaaaatgaagaagaagaacaaacactgaccatactgattagaacaggactgctggtgatatcaggactttttcccgtgtcaataccaatcacggcagctgcatggtacctgtgggaagtgaaaaaacaacgagccggagtattgtgggatgtcccttcgcctccacctgtgggaaaggccgaactggaagatggagcctatagaatcaagcagaaagggattctaggatactcgcagatcggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaatcataggcgccgtgtctctggacttttctcctggaacgtcaggatctccaattgtcgacaaaaaaggaaaagttgtgggcctttatggcaacggtgtcgtcacaaggagtggaacatatgtgagtgccatagcccagactgaaaaaagcattgaagacaacccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaattcctgaacgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattttgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgcgcacactggaaagaagctaagatgcttctagataacatcaacacgcctgaaggaatcattcccagcatgttcgaaccagagcgtgaaaaggtcgacgccattgatggtgaataccgcttgagaggagaagcgaggaaaacatttgtggacctaatgagaagaggagacctaccagtctggctagcctatagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttagatgctaggatctactctgacccactggcgctcaaagaattcaaggaattcgcagctggaagaaaatccctgaccttgaatctaatcaccgagatgggtaggctcccaaccttcatgacccagaaagcaaggaatgcactggacaacttagcagtcctgcatacagctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggccagtattctcctatggtatgcacaaatacagccacattggatagcagcttcaataatactggagttttttctaatagtcttgctcattccagaaccagaaaagcagagaacaccccaagacaaccaattaacttatgtcgtcatagccatccttacagtggtggccgcaaccatggcaaacgagatgggtttcctggaaaaaacaaagaaagatttcggattgggaagcattacaacccagcaacttgagagcaacatcctggacatagatctacgtcctgcatcagcttggactctatatgccgtggcaacaactttcatcacaccaatgttgagacatagcattgaaaattcctcagtgaatgtgtctctaacagccattgccaatcaagccacagtgttaatgggtcttgggaaaggatggccattgtcgaaaatggacatcggagttccccttctcgctatcggatgctactcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaggccctaaccttagcgaccgggcccatctctacactgtgggaaggaaatccagggagattttggaatacaactattgcagtgtcaatggctaacatttttagagggagttacctggccggagctggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaagagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaatagattcacaatgagacacaagaaggccacatacgagccagatgttgatctcggaagtggaacccgcaacatcggaattgaaagtgagacaccaaatctagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagagggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagagacttgccgaagccattttcagattaacgtaccaaaacaaagtggtgcgtgtgcaaagaccgacaccaagaggcacagtaatggacatcatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtacttgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7038 - RNA, 9876 nt, synthetic construct
  misc_feature 1..9876: note = derived and/or modified CDS sequence (wt) from DENV-2__KC762658__SS-prME
  source 1..9876: mol_type = other RNA
actgcaggtataattattatgatgatcccaacagtgatggcgttccatttaaccacacgcaacggagaaccacacatgatcgtcagtagacaagagaaggggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccccaggagaacacagaagggaaaaaagatcagtggcactcgttccccatgtgggaatgggactggagacacgaactgaaacatggatgtcatcagaaggggccgggaaacacgcccagagaattgaaacttgggtcttaagacatccaggctttaccataatggcagcaatcctggcatacaccataggaacaacatatttccaaagagtcctgatcttcattttactgacagctgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacttcccgccactctaaggaagtattgtatagaagcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattagtcactttcaaaaatccccatgcaaagaaacaggatgttgttgttttaggatcccaagaaggggccatgcatacagcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgtcttaggtcgcttgattacagtcaacccaattgtcacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagccatctatggggctgccttcagtggggtttcatggactatgaaaatcctcataggagtcgtcatcacatggataggaatgaattcacgcagcacctcactgtctgtgtcactagtattagtgggggtcgtgactttgtatttgggagttatggtgcaggccgatagtggttgcgttgtgagttggaaaaacaaagaactgaaatgtggcagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaagcaaataacaccagaattgaatcacattctatcagaaaatgaggtaaagttgactattatgacaggagacattaaaggaatcatgcaggcaggaaaacgatccctgcggcctcaacccactgagctgaagtactcttggaaaacatggggcaaagcgaaaatgctttccacagagcttcataaccacacctttctcattgatggccccgaaacagcagaatgtcctaacacaaacagagcttggaactcactagaagttgaagactatggctttggagtattcaccactaacatatggctgaaattgaaagaaaggcaggatgtattttgtgactcaaaactcatgtcagcagccataaaagacaacagagccgtccacgccgatatgggttattggatagaaagtgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgaccgaggactgtggaaatagaggaccctccctaagaacaaccactgcttctggaaaactcataacagagtggtgctgccgatcttgcacattaccaccgctaaggtacagaggtgaagatggatgctggtatggaatggaaatcagaccattgaaagagaaagaagagaacttggtcaactctttggtcacagccggacatggacagattgacaacttctcactaggagtcttgggaatggcattgttcctggaagagatgctcagaacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgctctattagcagccttcaaagtcagaccaacttttgcggctggactactcttaagaaagctgacctccaaggaattgatgatgaccaccataggaatcgtactcctctctcagagtaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagcagtccaattctgtcgataacaatatcggaagatggtagcatgtcgataaaaaatgaagaagaagaacaaacactgaccatactcattagaacaggactgctggtgatatcaggactttttcctgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggatcctaggatactcgcagattggagccggagtttataaagaaggaacattccacacaatgtggcatgtcacacgtggtgctgtcctaatgcataaagggaagagaattgaaccatcatgggcggacgttaagaaagacctaatatcgtatggaggaggctggaagctagaaggagaatggaaggaaggagaagaagtccaggtcctggcattagagcctggaaagaatccaagagccgtccaaacaaaacccggtctttttaaaaccaacactggaaccataggcgccgtgtctctggacttttctccaggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggttacatttcaactcgagtagagatgggtgaagcagctggtattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcggcctgcctgagaaagaatggaaagaaagtgatacaactcagcaggaagacttttgattttgaatacatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaacccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagagcgtgaaaaggtggatgccattgatggtgaataccgcctgagaggagaagcgaggaaaacctttgtggaactaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctagaatctactctgacccactggcgctcaaagaattcaaggaattcgcagctggaagaaagtccctgaccctgaatctaatcacagagatgggtagactcccaaccttcatgacccagaaagcaaggaatgcactagacaacttagcagtcttgcatacggctgaagcaggcggaagggcgtacaatcatgctcttagtgaactgccggagactctggaaacattgcttttactgacacttttggccacagtcacgggcggaatcttcctgttcttgatgagcggaaagggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagattttggattgggaagcattacaacccagcaacctgagagtaacatcctggacatagatctacgtcctgcatcagcttggactctatatgccgtggcaacaactttcatcacaccaatgttgaggcatagcattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctattatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactatcgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgcagtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagcggagttgatgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaaggatgttgattaacagattcacaatgagacacaagaaagccacatacgagccagatgttgacctcggaagtggaacccgcaacatcggaattgaaagtgagacaccaaatttagacataattgggaaaagaatagagaaaataaaacaagagcatgaaacatcatggcactatgaccaagaccacccatacaaaacgtgggcctaccatggcagctacgaaacaaaacagacaggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcggccttaggtgccatattcactgatgagaacaagtggaagtcggcacgtgaggctgttgaagacagtggattttgggaattggttgacaaggaaaggaacctccatcttgaaggaaagtgtgagacatgtgtgtataacatgatgggaaagagagagaagaagctaggggaattcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgaggagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcctacgcccaaatgtggagcctgatgtacttccacagacgtgaccttaggctggcagcaaatgccatttgctcggcagtcccatcacattgggttccaacaagtcgaacaacctggtccatacacgccacacatgagtggatgacaacagaagacatgctgacagtctggaacagggtctggattcaagaaaacccatggatggaagacaaaactccagtagaatcatgggaggaaatcccgtatttggggaaaagagaagaccaatggtgcggctcattgattgggctaacaagcagagctacctgggcaaagaacatccaaacagcaataaatcaagttagatccctaataggcaatgagaaatacacagactacatgccatccatgaaaagattcagaagagaagaggaagaggcaggagtcttgtggtag

SEQ ID NO: 7039 - RNA, 9876 nt, synthetic construct
  misc_feature 1..9876: note = derived and/or modified CDS sequence (wt) from DENV-2__KC762660__SS-prME
  source 1..9876: mol_type = other RNA
actgcaggcataattattatgatgatcccaacagtgatggcgttccatttaaccacacgcaacggagaaccacacatgatcgtcagtagacaagagaaagggaaaagtcttctgtttaaaacagagaacggtgtgaacatgtgcaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggctttaccataatggcagcaatcctggcatacaccataggaacaacatatttccaaagagtcctgattttcattttactgacagctgtcactccttcaatgacaatgcgttgtataggaatatcaaatagagactttgtggaaggggtttcaggaggaagctgggttgatatagtcttggaacatggaagctgtgtgacgacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaaaggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacacggcaaggaaattaaagtaacaccacagagttccatcacagaagcagaattaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcctggagcagacacacaaggatcaaattggatacagaaggagacactggtcactttcaaaaatcctcatgcaaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgtcttaggtcgcttgattacagtcaacccaattgtcacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggatagggatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtgcacacatggacagaacaatacaaatttcaaccagaatccccttcaaagctggcttcagctatccagaaggctcatgaagaaggcatttgtggaatccgctcagtgacaagactggagaatctgatgtggaaacaaataacaccagaattgaatcacattctatcagaaaatgaggtaaagctgactatcatgacaggagacattaaaggaatcatgcaggcaggaaaacgatccctgcggcctcaacccactgagctgaagtactcttggaaaacatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtattttgtgactcaaaactcatgtcagcagccataaaagacaacagagccgtccacgccgatatgggttattggatagaaagcgcactcaatgacacatggaagattgaaaaagcctctttcattgaagttaaaagctgccactggccaaagtcacacactctctggagtaatggagtgctggaaagtgagatgataattccaaagaattttgcaggaccagtgtcacaacacaattacagaccaggctatcatacacaaacagcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgctcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgactaccataggaatcgtactcctctctcagagtaccataccagagagcatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagtaagaaaaggagctggccactaaatgaggctattatggcagtcgggatggtgagcattctagccagttccctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaatcctgtcgataacaatatcggaagatggtagcatgtcgataaaaaatgaagaagaagaacaaacactgaccatactcattagaacaggactgctggtgatatcaggactttttcctgtgtcaataccaattacggcagctgcatggtacctgtgggaagtgaaaaaacaacgagcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaacccaagagccgtccaaacgaaacccggtctttttaaaaccaacactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgattatcatggatgaagcccatttcatagacccagcaagcatagcagccagaggatacatttcaactcgagtggagatgggtgaagcagctgggattttcatgacagccacccctcctggaagcagagacccatttcctcagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccactctagtgcagcacaaagaagagggagagtaggaagaaatccaaaaaatgaaaatgaccagtacatatacatgggggaacctttggaaaatgatgaagactgtgcacactggaaagaagctaagatgcttttggataacatcaacacgcctgaaggaatcattcccagcatgttcgaaccagagcgtgaaaaggtggatgccattgatggtgaataccgcttgagaggagaagcgaggaaaacctttgtggacctaatgagaagaggagatctaccagtctggttagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtagactcccaaccttcatgacccagaaagcaaagaatgcactggacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagacaaccagttaacttatgttgtcatagccatcctcacagtggtggccgcaactatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgctgaggcatagcattgaaaattcctcagtgaatgtgtctctaacagccattgccaaccaggccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagctggacttctcttttctatcatgaaaaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgtgttttcaaagagaaagtggacacgagaactcaagaaccgaaagaaggcacgaaaaaattaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagctttaggattcttgaatgaagatcactggttttccagagagaactccctgagtggagtggaaggagaagggctgcacaaactaggctacattttaagagatgtgagtaagaaagaaggaggagcaatgtatgccgatgacaccgcaggatgggacacaagaatcacactagaggacttaaagaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcaggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaattccgtatttggggaaaagagaggaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttatggtag

SEQ ID NO: 7040 - RNA, 9876 nt, synthetic construct
  misc_feature 1..9876: note = derived and/or modified CDS sequence (wt) from DENV-2__KC762676__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtactctcatggccatggaccttggtgaactgtgtgaagacacaatcacttataattgtcctctcctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacactataggaacgacacatttccaaagagtcctgatcttcatcttactgacagctgtcgctccttcaatgacaatgcgttgcataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaattgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggtactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcacacagcactcacaggggccacggaaatccagatgtcatcaggaaacttactgttcactggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccatgtaagatcccttttgaaataatggatttggaaaaaagacatgtcctaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacttcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcctcagctatccagaaggctcacgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaaacatggggcaaagcgaaaatgctctccacagagcttcacaaccacacctttctcattgatggccccgaaacagcagaatgtcccaacacaaacagagcttggaactcactagaagtcgaagactatggctttggagtattcaccaccaacatatggctgaaattgaaagaaaggcaggatgtatattgtgactcaaaactcatgtcagcagccataaaagataacagagccgtccacgccgatatgggttattggatagaaagcgcactcaatgacacatggaagattgagaaagcctcttttattgaagttaaaagctgctactggccaaagtcacacaccctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccactaaggtacagaggtgaggatggatgctggtatggaatggaaattagaccactgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggattactcttaagaaagctgacctccaaggaattgatgatgaccaccataggaatcgtgctcctctcccagagcaccataccagagactatacttgaactgactgacgcattggctttggggatgatggctctcaaaatagtgagaaacatggaaaagtatcaactagcagtgactatcatggccatcttgtgcgttccaaatgcagtgatattacaaaacgcatggaaagtgagctgcacaacactggcagtggtgtccgtttccccactgcttttaacatcctcacagcagaaagcggattggataccactggcgttgacgatcaaaggccttaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtactcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttagtgatatcaggactttttcccgtatcaataccaatcacggcagctgcatggtacctgtgggaagtgaaaaaacaacgagcaggagtattgtgggatgtcccctcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagttagaaggagaatggaaagaaggagaagaagtccaggtcctggcattagagcctggaaagaatccaagagctgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacttgattatcatggatgaagcccatttcacagacccagcaagcatagcagctagaggatacatttcaactcgagtagagatgggtgaagcagctgggattttcatgacagctacccctcctggaagtagagacccatttcctcagagcaatgcaccaatcatggatgaagaaagggaaatccctgagcgttcgtggaactctggacatgaatgggttacggattttaaagggaagactgtttggtttgttccaagcataaaagcagggaatgatatagcagcttgcctgagaaagaatggaaagaaagtgatacaactcagcaggaagacttttgattttgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgctcctagacaacatcaacacgcctgaaggaatcattcccagcatgttcgaaccagagcgtgaaaaggtggatgccattgatggtgaataccgcttgagaggagaagcaagaaaaacttttgtggacctaatgagaagaggagacctaccagtctggttagcctacagagtggcagctgaaggtatcaactacgcagacagaagatggtgctttgatggagtcaagaacaaccaaatcttggaagaaaatgtggaagtggaaatttggacaaaagaaggagaaaggaagaaattgaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaatcatgctcttagtgaactgccggagactctggagacattgcttttactgacactcttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagttttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcattacaacccagcaacctgagagcaatatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagtttcccttctcgctatcgggtgctattcacaagtcaaccccataactctcacagcagcccttctcttattggtagcacattatgctatcatagggccaggactccaagcgaaagcaactagagaggctcaaaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacttggccggagccggacttctcttttctatcatgaagaacacggctaacacaagaaggggaactggcaacacaggagagacgcttggagagaaatggaaaaaccggttgaatgcattggggaagagtgaattccagatctataagaaaagtggaatccaggaagtggatagaaccttggcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgtttttttcactccgccagaaaagtgtgatacattgctgtgtgacataggggagtcgtcaccaaaccccacggttgaagcaggacgaactctcagagttctaaacttagtggaaaattggctgaacaacaacacccaattttgcataaaggttctcaacccatatatgccctcagttatagaaaaaatggaagcactacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaataaaacaagagcatgaaacatcatggcattatgaccaagatcacccatacagaacgtgggcctatcatggcagctacgaaacaaaacagactggatcagcatcatccatggtgaacggagtggttaggttgctaacaaaaccttgggacgttatccctatggtgacacagatggcaatgacagatacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaacgaagatcactggttttccagagagaactccctgagtggagtggaaggagaagggctgcacaaactaggctacattttaagagacgtgagtaagaaagaaggaggagcaatgtacgctgatgacaccgcaggatgggacacaagaatcacattagaggacttaaaaaacgaagaaatggtgacaaaccacatggaaggagaacacaagaaacttgctgaagccatcttcaaattaacgtaccaaaacaaggtggtgcgtgtgcaaagaccaacgccaagaggcacagtaatggacattatatcgagaagagaccaaagaggtagcggacaagttgtcacctacggcctcaatactttcaccaacatggaagcccaactgatcagacagatggaaggagaaggagtcttcaaaagcatccagcaattgacagtcacagaagaaattgcagtgaaaaactggttagtaagagtggggcgtgagaggttatcaagaatggccatcagtggagatgattgtgttgtgaaacccttagatgacaggtttgcaaacgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcagcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaattccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagggaagaggaagaggcaggagtcttgtggtag

SEQ ID NO: 7041 - RNA, 9876 nt, synthetic construct
  misc_feature 1..9876: note = derived and/or modified CDS sequence (wt) from DENV-2__KC762662__SS-prME
  source 1..9876: mol_type = other RNA
actgcaggtataattatcatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaattgaaacttgggtcttgagacatccaggcttcaccataatggcagcaatcctggcatataccataggaacaacatatttccaaagagtcctgattttcattttactgacagctgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcctgccactctaaggaagtattgtatagaggcaaagctgaccaacacaacaacagcatctcgttgcccaacacaaggagaacctagcctaaacgaagaacaggacaaaaggttcgtctgcaaacactccatggtagacagaggatggggaaatggatgcggattatttggaaagggaggcatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacatggcaaggaaattaaagtaacaccacagagttccatcacagaagcagagctaacaggctatggcactgtcacgatggaatgctctccgagaacgggcctcgacttcaatgagatggtgttgctgcaaatggaaaataaggcttggctggtgcacaggcaatggttcttagacctgccgttaccatggctgcccggagcagacacacaaggatcaaattggatacagaaggagacattggtcactttcaaaaacccccatgcaaagaaacaggatgttgttgttttaggatcccaagaaggggctatgcatacagcactcacaggggccacggaaatccagatgtcatcaggaaacctactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgttttaggtcgcttgattacagtcaacccaattgtcacagaaaaagatagcccagtcaacatagaagcagaacctccattcggagacagctacatcattataggagtagaaccgggacaactgaagctcagctggtttaagaaaggaagttctattggccaaatgtttgagacaacaatgagaggagcgaaaagaatggccattttaggtgacacagcttgggattttggatccctgggaggagtgttcacatctataggaaaggccctccaccaagtcttcggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgtgagttggaaaaacaaagaactgaaatgcggcagtgggatttttatcacagacaacgtgcacacatggacagaacaatacaaattccaaccagaatccccttcaaagctggcttcagccatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtgttcaccactaacatatggctgaaattgaaagaaaggcaggatgcattttgtgactcaaaactcatgtcagcagccataaaagacaacagagccgttcacgccgatatgggttattggatagaaagcgcactcaacgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggattgtggaaatagaggaccctccttaaggacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgatataggcatgggcgtgacttatcttgccctgttagcagccttcaaagtcagaccaacttttgcggctggactactcttaagaaagctgacctccaaggaattgatgatgaccaccataggaatcacactcctctctcagagtaccataccagagactatacttgaactgactgacgcgttggctttggggatgatggttctcaaaatagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactcgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttcctgtgtcaataccaatcacagcagctgcatggtacctgtgggaagtgaaaaaacaacgggcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcacaaagggaaaagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacgctaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagccacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtagactcccaaccttcatgacccagaaagcaaggaatgcactggacaacttagcagtcctgcatacggctgaagcaggcggaagggcgtacaatcatgctcttagtgaactgccggagactctggaaacattgcttttactaacacttttggccacagtcacgggcggaatcttcctgttcttgatgagcggaaaaggtgtagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaactatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacactttgctgtgtgacataggggagtcgtcaccaaaccctacggttgaggcaggacgaacactcagagttctaaacttagtggaaaattggctgaataacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacaaatggcaatgacagacacgactccatttggacaacagcgcgtcttcaaagagaaagtggacacaagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagctctaggattcctgaatgaagatcactggttttccagagagaactccctgagtggagtggaaggagaaggactgcacaaactaggttacattttaagagacgtgagcaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtatcaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcaactgacagtcacagaagaaattgcagtgaaaaactggttagtgacagtggggcgtgagaggttatcaagaatggctatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgagaaacagcctgtttggggaagtcctacgcccaaatgtggagcttgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaataaatcaagtcagatccctaataggcaatgaggaatacacagactacatgccatccatgaaaagattcagaagagaagaggaagaggcaggagtcttgtggtag

SEQ ID NO: 7042 - RNA, 9876 nt, synthetic construct
  misc_feature 1..9876: note = derived and/or modified CDS sequence (wt) from DENV-2__KC762661__SS-prME
  source 1..9876: mol_type = other RNA
actgcaggtataattatcatgatgatcccaacagtgatggcgttccatttaaccacacgcaatggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaattgaaacttgggtcttgagacatccaggcttcaccataatggcagcaatcctggcatataccataggaacaacatatttccaaagagtcctgattttcattttactgacagctgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcctgccactctaaggaagtattgtatagaggcaaagctgaccaacacaacaacagcatctcgctgcccaacacaaggagaacctagcctaaacgaagaacaggacaaaaggttcgtctgcaaacactccatggtagacagaggatggggaaatggatgcggattatttggaaagggaggcatcgtgacctgtgcaatgttcacatgcaaaaagaacatggagggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaataaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacctactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgttttaggtcgcttgattacagtcaacccaattgtcacagaaaaagatagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtcttcggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgtgagttggaaaaacaaagaactgaaatgcggcagtgggatttttatcacagacaacgtgcacacatggacagaacaatacaaattccaaccagaatccccttcaaagctggcttcagccatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtattcaccactaacatatggctgaaattgaaagaaaggcaggatgcattttgtgactcaaaactcatgtcagcagccataaaagacaacagagccgttcacgccgatatgggttattggatagaaagcgcactcaacgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctatcaaacacaaacggcaggaccctggcatctaggtaggcttgagatggactttgatttctgcgaaggaaccacagtggtggtgactgaggattgtggaaatagaggaccctccttaagaacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctacgatgacggatgacataggcatgggcgtgacttatcttgccctattagcagccttcaaagtcagaccaacttttgcggctggactactcttaagaaagctgacctccaaggaattgatgatgaccaccataggaatcacactcctctctcagagtaccataccagagactatacttgaactgactgacgcgttggctttagggatgatggttctcaaaatagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactcgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttcctgtgtcaataccaatcacagcagctgcatggtacctgtgggaagtgaaaaaacaacgggcaggggtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcataaagggaaaagaattgaaccatcatgggcggacgtcaagaaagacctaatatcgtatggaggaggctggaagctagaaggagaatggaaggaaggagaagaagtccaggtcctggcattagagcctggaaagaatccaagggccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccaccagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagctacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaggaatgcactggacaacttagcagttctgcatacggctgaagcaggcggaagggcgtacaatcatgctcttagtgaactgccggagactctggaaacattgcttttactgacacttttggccacagtcacgggcggaatcttcctgttcttgatgagcggaaaaggtatagggaagatgaccctgggaatgtgctgcataatcacggctagtattcttctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccctatgatccaaagttcgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctataatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacactttgctgtgtgacataggggagtcgtcaccaaaccctacggttgaggcaggacgaacactcagagttctaaacttagtggaaaattggctgaataacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcctccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacaaatggcaatgacagacacgaccccatttggacaacagcgcgtcttcaaagagaaagtggacacaagaacccaagaaccgaaagaaggcacgaaaaaattaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagccctaggattcctgaatgaagatcactggttttccagagagaactccctgagtggagtggaaggagaaggactgcacaaactaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaactcgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcaactgacagtcacagaagaaattgcagtgaaaaactggttagtgagagtggggcgtgagaggttatcaagaatggctatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcctacgcccaaatgtggagcctgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7043 - RNA, 9876 nt, synthetic construct
  misc_feature 1..9876: note = derived and/or modified CDS sequence (wt) from DENV-2__KC762655__SS-prME
  source 1..9876: mol_type = other RNA
actgcaggtataattattatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggcgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcatacaccataggaacaacatatttccaaagagtcctgattttcattttactgacagctgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaaaggaggcatcgtgacctgtgcaatgttcacatgcaaaaagaacatggaaggaaaagtcgtgcaaccagaaaacttggagtacaccattgtgataacacctcattcaggggaagagaatgcagtcggaaatgacacaggaaaacacggtaaggaaattaaagtaacaccacagagttccatcacagaagcagaactaacaggctatggcactgtcacgatggaatgctctccgagaacgggcctcgacttcaatgagatggtgctgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatccctttcgaaataatggacttggaaaaaagacatgtcttaggtcgcttgattacagtcaacccaattgtcacagaaaaagacagcccagttaacatagaagcagaacctccattcggagacagctacatcattataggagtagaaccgggacaactgaagctcagctggtttaagaaaggaagttctattggccaaatgtttgagacgacaatgagaggagcgaagagaatggccattttaggtgatacagcttgggattttggatccctgggaggagtgttcacatctataggaaaggccctccaccaagtttttggagctgtctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtgcacacatggacagaacaatacaaattccaaccagaatctccttcaaagctggcttcagctatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaagcaggaaaacgatccctgcggcctcaacccactgagctgaagtactcttggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtattttgtgactcaaaactcatgtcagcagccataaaagacaacaaagccgtccacgccgatatgggttattggatagaaagcgcactcaatgacacatggaagattgagaaagcctcttttattgaagttaaaagctgccactggccaaagtcacacaccctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggaatggaaatcagaccattgaaagagaaagaagagaacttggtcaattctttggtcacagccgggcatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttaccttgccctattagcagccttcaaagtcagaccaacttttgcggctggactactcttaagaaagctgacctccaaggaattgatgatgaccaccataggaatcgtactcctctcacagagtaccataccagagactatacttgaactgactgatgcgttggctttggggatgatggttctcaaaatagtgagaaatatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcaggaagtagtccaattctgtcgataacaatatcggaagatggtagcatgtcgataaaaaatgaagaagaagaacaaacactgaccatactcatcagaacaggactgctggtgatatcaggactttttcctgtgtcaataccaatcacggcaactgcatggtacctgtgggaagtgaaaaaacaacgagcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggcgctgtcctaatgcataaagggaagagaattgaaccatcatgggcggacgtcaaaaaagacctaatatcgtatggaggaggctggaagctagaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgacaaaaaaggaaaagttgtgggcctttatggcaacggtgttgtcacaaggagtggaacatatgtgagtgccatagcccagactgaaaaaagtatcgaagacaatccagagattgaagatgacatctttcgaaagaaaagattgaccatcatggacctccacccaggagcagggaaaacaaagagataccttccagcaatagtcagagaggccataaaacgaggcttgagaacactaatcctggcccccactagagttgtggcggctgaaatggaagaagctctcagaggacttccaataagataccaaaccccagctatcagagctgagcacactgggcgggagattgtggacctaatgtgtcacgccacatttaccatgaggctactatcaccaattagagtgccaaattacaacctgattatcatggatgaagcccatttcacagacccagcaagcatagcagctagaggatacatttcaactcgtgtagagatgggtgaagcagctggtattttcatgacagctacccctcctggaagcagagacccatttcctcagagcaatgcaccaatcatggatgaagaaagagaaatccctgagcgttcgtggaactctggacatgagtgggttacggattttaaagggaagactgtttggtttgttccaagtataaaagcagggaatgacatagcagcttgcctgagaaagaatggaaagaaagtgatacaactcagcaggaagacttttgactttgaatatatcaagaccaggaccaatgattgggactttgtagtcacgacagacatttcagaaatgggtgctaacttcaaggctgagagggttatagaccccagacgctgcatgaaaccagtcatattaacagacggtgaagagcgggtgatcttggcaggacccatgccagtgacccactctagtgcagcacaaagaagagggagagtaggaaggaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaacgtggaagtagaaatttggacaaaagaaggagaaaggaagaaattaaaacccagatggttggatgctaggatctactctgacccactggcgctcaaagaattcaaggaattcgcagccggaagaaagtccctgaccctgaatctaatcacagagatgggtagacttccaaccttcatgacccagaaagcaaggaatgcactggacaatttagcagtcctgcatacggctgaagcaggcggaagggcgtacaatcatgctcttagtgaactgccggagactctggaaacactgcttttactgacacttttggccacagtcacgggcggaatcttcttgttcttgatgagcggaaagggtatagggaagatgaccctgggaatgtgttgcataatcacggctagtattctcctatggtatgcacaaatacagccacactggatagcagcttcaataatactggagttttttctcatagtcttgcttattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcattgcaacccagcaacctgaaagtaacatcctggacatagacctacgtcctgcatcagcttggactctatatgccgtggcaacaaccttcatcacaccaatgttgaggcatagcatagaaaattcctcagtgaatgtgtctttaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacactatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggctaacacaagaaggggaactggcaacacaggagagacgcttggagagaaatggaaaaaccggctgaatgcattggggaagagtgaattccagatctataagaaaagtggaatccaggaagtggatagaaccttagcaaaagaaggcattaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaacctggtgcgtcttcaaagtggagttgatgttttttttactccgccagaaaagtgtgacacactgctgtgtgacataggggagtcttcaccaaaccccacggttgaggcaggacgaacactcagagttctaaacttagtggaaaattggctgaacaacaacacccaattttgcataaaggttctcaacccatacatgccctcagttatagaaaaaatggaagcgctacaaagaaaatacggaggagctttggtgaggaatccactctcacgaaattccacacacgagatgtactgggtatccaatgcttccgggaacatagtgtcatcagtgaacatgatttcaagaatgttgattaacagatttacaatgagacacaagaaagccacatacgaaccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaagatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtggattttgggaattagttgacaaggaaaggagcctccatcttgaaggaaagtgtgagacatgtgtgtacaacatgatgggaaagagagagaagaaactaggggagttcggcaaagcaaaaggcagcagggccatatggtacatgtggcttggagcacgcttcttagagtttgaagctctaggattcttgaatgaagatcactggttttccagagagaactccctgagtggagtggaaggagaagggctgcacaaactaggctacattttaagagacgtaagtaagaaagaaggaggagcaatgtatgccgatgacaccgcaggatgggacacaagaatcacactagaggacttaaagaatgaagaaatggtgacaaaccacatggaaggagaacacaagaaacttgctgaagccattttcaaattaacgtaccaaaacaaggtggtgcgtgtgcaaagaccaacaccaagaggcatagtaatggacattatatcgagaagagaccaaagaggtagtggacaagttgtcacgtacggcctcaatactttcaccaacatggaagcccaactgatcagacagatggagggagaaggagtcttcaaaagcatccagcaactgacagtcacagaagaaattgcagtgaaaaattggttagcaagagtggggcgtgagaggttgtcaagaatggccatcagtggagatgattgtgttgtgaaacccttagatgacaggtttgcaagtgctctaacagctctaaatgacatgggaaaggtcaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaggaacatccaaacagcaataaatcaagttagatccctaataggcaatgaggaatacacagactacatgccatccatgaaaagattcagaagagaagaggaagaggcaggagtcttgtggtag

SEQ ID NO: 7044 - RNA, 9876 nt, synthetic construct
  misc_feature 1..9876: note = derived and/or modified CDS sequence (wt) from DENV-2__KC762656__SS-prME
  source 1..9876: mol_type = other RNA
actgcaggtataattattatgatgatcccaacagtgatggcgttccatttaaccacacgcaacggagagccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacacgtgggaatgggactggagacacgagctgaaacatggatgtcatcagaaggggcctggaaacatgcccagagaattgaaacttgggtcttgagacatccaggcttcaccataatggcagcaatcctggcatacaccataggaacaacatatttccaaagagtcctgatcttcattttactgacagctgtcactccctcaatgacaatgcgttgtataggaatatcaaacagagactttgtggaaggggtttcaggagggagctgggttgacatagtcttggaacatggaagctgtgtgacgacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcattgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacagacaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttactgttcacagggcatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatccctttcgaaataatggacttggaaaaaagacatgtcttaggtcgcttgattacagtcaacccaattgtcacagaaaaagacagcccagtcaacatagaagcagaacctccattcggagacagctacatcattataggagtagaaccgggacaactgaaactcagctggtttaagaaaggaagttctattggccaaatgtttgagacgacaatgagaggagcgaagagaatggccattttaggtgatacagcttgggattttggatccctgggaggagtgttcacatctataggaaaggccctccaccaagtttttggaactatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtgcacacatggacagaacaatacaaattccaaccagaatccccctcaaagctggcttcagctatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaagcaggaaaacgatccctgcggcctcaacccactgagctgaagtactcttggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccaatggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaagatacagaggtgaggatggatgctggtatggaatggaaatcagaccattgaaagagaaagaagagaacttggtcaattctttggtcacagccgggcatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattaatgatgaccaccataggaatcgtactcctctcacagagtaccataccagagactatacttgaactgactgatgcattggctttgggaatgatggttctcaaaatagtgagaaatatggaaaagtatcaactagcagtgactatcatggccatcttgtgcgtcccaaatgcagtgatattacaaaacgcatggaaagtgagttgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccactagtggctggagggcttctcactgtgtgttacgtgctcactggaagatcggctgatttggaactggaaagagctgctgacgtaagatgggaagaacaggcagaaatatcaggaagtagtccaattctgtcaataacaatatcggaagatggtagcatgtcgataaaaaatgaagaagaagaacaaacactgaccatactcatcagaacaggactgctggtggtatcaggactctttcctgtatcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtactaatgcataaagggaagagaattgaaccatcatgggcggacgtcaaaaaagacctaatatcgtatggaggaggctggaagctagaaggagaatggaaggaaggagaagaagtccaggtcctggcattagagcctggaaagaacccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgttgtcacaaggagtggaacatatgtgagtgccatagcccagactgaaaaaagtatcgaagacaatccagagattgaagatgacatctttcgaaagaaaagattgaccatcatggacctccacccaggagcagggaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgatcatcatggatgaagcccatttcacagacccagcaagcatagcagctagaggatacatttcaactcgagtagagatgggtgaagcagctggtattttcatgacagctacccctcctggaagcagagacccatttcctcagagtaatgcaccaatcatggacgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaatcaaatcttggaagagaatgtggaagtagaaatttggacaaaagaaggagaaaggaagaaattaaaacccagatggttggatgctaggatctactctgacccactggcgctcaaagaattcaaggaattcgcagctggaagaaaatccctgaccctgaatctaatcacagagatgggtagactcccaaccttcatgacccagaaagcaaggaatgcactggacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaagggtatagggaagatgaccctgggaatgtgctgcataatcacggctagcattctcctatggtatgcgcaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggttttctggaaaaaacaaagaaagatttcggattgggaagcattgcaacccagcaacctgagagtaacatcctggacatagatctacgtcctgcatcagcttggactctatatgccgtggcgacaactttcatcacaccaatgttgaggcatagcatagaaaattcctcggtgaatgtgtctctaacagccattgccaaccaagccacagtgttaatgggtcttgggaaaggatggccattatcaaaaatggacatcggagttcccctcctcgctatcgggtgctattcacaagtcaaccccataactctcacagcagcccttctcttattggtagcacactatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtatcaatggctaacatttttagagggagttacctggccggagccggacttctcttttccatcatgaaaaacacggccaacacaagaaggggaactggcaacacaggagagacgcttggagagaaatggaaaaaccggttgaatgcattggggaagagtgaattccagatctacaagaaaagtggaatccaggaagtggatagaaccttagcaaaagaaggcattaaaagaggagaaacggaccatcacgctgtgtcgcgaggctcagcgaagctgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggtcctcaacccatacatgccctcagttatagaaaaaatggaagcgttacaaaggaaatacggaggagctttggtgaggaatccactctcacgaaattccacacacgagatgtactgggtatccaatgcctccgggaacatagtgtcatcagtgaacatgatttcaagaatgttgattaacagattcacaatgagacacaagaaagccacatacgaaccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacgaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggcgccatattcactgatgagaacaagtggaagtcggcacgtgaggctgttgaagacagtggattttgggaattggttgacaaggaaaggaacctccatcttgaaggaaagtgtgagacatgtgtatacaacatgatgggaaagagagagaagaagctaggggagttcggcaaagcaaaaggcagcagggccatatggtacatgtggcttggagcacgcttcttagagtttgaagctctaggattcttgaatgaagatcactggttttccagagagaactccctgagtggagtggaaggagaagggctgcacaaactaggctacattttaagagacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaatcgcagtgaaaaactggttagtaagagtggggcgtgagaggttgtcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgactggacacaagtgcctttttgttcacaccatttccatgagctaatcatgaaggacggtcgtgtactcgtagttccatgcagaaaccaagatgaactgattggtagggcccgaatttcccagggagccgggtggtccttgcgggaaacagcctgtttggggaagtcctacgcccaaatgtggagcctgatgtacttccacagacgtgaccttaggctggcggcaaatgctatttgctcggcagtcccatcacattgggttccaacaagtcgaacaacctggtccatacacgccacacatgagtggatgacaacagaagatatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaattaatcaagttagatccctaataggcaatgaggaatacacagactacatgccatccatgaaaagattcagaagagaagaggaagaggcaggagtcttgtggtag

SEQ ID NO: 7045 - RNA, 9876 nt, synthetic construct
  misc_feature 1..9876: note = derived and/or modified CDS sequence (wt) from DENV-2__KC762673__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtactctcatggccatggaccttggtgaactgtgtgaagacacaatcacttataattgtcctctcctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacactataggaacgacacatttccaaagagtcctgatcttcatcttactgacagctgtcgctccttcaatgacaatgcgttgcataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaattgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggtactgttacgatggaatgctctccgagaacgggcctcgacttcaatgagatggtgttgctgcaaatggaaaacaaagcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcacacagcactcacaggggccacagaaatccagatgtcatcaggaaacttactgttcactggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccatgtaagatcccttttgaaataatggatttggaaaaaagacatgtcctaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggagtgttcacatccataggaaaggccctccaccaagtctttggagcaatctatggggctgccttcagtggggtttcatggactatgaaaatcctcataggagtcgtcatcacatggataggaatgaattcacgcagcactccactgtctgtgtcactagtattagtgggggtcgtgacattgtatttgggagttatggtgcaggctgatagtggttgcgttgtgagttggaaaaacaaagaactgaaatgtggcagtgggatttttatcacagacaacgtacacacatggacagaacaatacaaattccaaccagaatccccttcaaagctggcctcagctatccagaaggctcacgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaaacatggggcaaagcgaaaatgctctccacagagcttcacaaccacacctttctcattgatggccccgaaacagcagaatgtcccaacacaaacagagcttggaactcactagaagtcgaagactatggctttggagtattcaccaccaacatatggctgaaattgaaagaaaggcaggatgtatattgtgactcaaaactcatgtcagcagccataaaagataacagagccgtccacgctgatatgggttattggatagaaagcgcactcaatgacacatggaagattgagaaagcctcttttattgaagttaaaagctgctactggccaaagtcacacaccctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccactaaggtacagaggtgaggatggatgctggtatggaatggaaattagaccactgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatctcgccctattagcagccttcaaagtcagaccaacttttgcagctggattactcttaagaaagctgacctccaaggaattgatgatgaccaccataggaatcgtgctcctctcccagagcaccataccagagactatacttgaactgactgacgcattggctttggggatgatggctctcaaaatagtgagaaacatggaaaagtatcaactagcagtgactatcatggccatcttgtgcgttccaaatgcagtgatattacaaaacgcatggaaagtgagctgcacaacactggcagtggtgtccgtttccccactgcttttaacatcctcacagcagaaagcggattggataccactggcgttgacgatcaaaggccttaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtactcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttagtgatatcaggactttttcccgtgtcaataccaatcacggcagctgcatggtacctgtgggaagtgaaaaaacaacgagcaggagtattgtgggatgtcccctcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagttagaaggagaatggaaagaaggagaagaagtccaggtcctggcattagagcctggaaagaatccaagagctgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagatatcaaaccccagctatcaaagctgagcacactgggcgggagattgtggatctaatgtgtcacgccacatttaccatgaggctactatcaccaattagagtgccaaattacaacttgattatcatggatgaagcccattttacagacccagcaagcatagcagctagaggatacatttcaactcgagtagagatgggtgaagcagctgggattttcatgacagctacccctcctggaagtagagacccatttcctcagagcaatgcaccaatcatggatgaagaaagggaaatccctgagcgttcgtggaactctggacatgaatgggttacggattttaaagggaagactgtttggtttgttccaagcataaaagcagggaatgatatagcagcttgcctgagaaagaatggaaagaaagtgatacaactcagcaggaagacttttgattttgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacccctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcaagaaaaacttttgtggacctaatgagaagaggagacctaccagtctggttagcctacagagtggcagctgaaggtatcaactacgcagacagaagatggtgttttgatggagtcaagaacaaccaaatcttggaagaaaatgtggaagtggaaatttggacaaaagaaggagaaaggaagaaattgaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaaccatgctcttagtgaactgccggagactctggagacattgcttttactgacactcttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatattggagttttttctcatagtcttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcattacaacccagcaacctgagagcaatatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacataggagttccccttctcgctatcgggtgctattcacaagtcaaccccataactctcacagcagcccttctcttattggtagcacattatgctatcatagggccaggactccaagcgaaagcaactagagaggctcaaaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacttggccggagccggacttctcttttctatcatgaagaacacggctaacacaagaaggggaactggcaacacaggagagacgcttggagagaaatggaaaaaccggttgaatgcattggggaagagtgaattccagatctataagaaaagtggaatccaggaagtggatagaaccttggcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgttttttttactccgccagaaaagtgtgatacattgctgtgtgacataggggagtcgtcaccaaaccccacggttgaagcaggacgaactctcagagttctaaacttagtggaaaattggctgaacaacaacacccaattttgcataaaggttctcaacccatatatgccctcagttatagaaaaaatggaagcgctacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaataaaacaagagcatgaaacatcatggcattatgaccaagatcacccatacagaacgtgggcctatcatggcagctacgaaacaaaacagactggatcagcatcatccatggtgaacggagtggttaggttgctaacaaaaccttgggacgttatccctatggtgacacagatggcaatgacagatacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaacgaagatcactggttttccagagagaactccctgagtggagtggaaggagaagggctgcacaaactaggctacattttaagagacgtgagtaagaaagaaggaggggcaatgtacgctgatgacaccgcaggatgggacacaagaatcacattagaggacttaaaaaacgaagaaatggtgacaaaccacatggaaggagaacacaagaaacttgctgaagccatcttcaaattaacgtaccaaaacaaggtggtgcgtgtgcaaagaccaacgccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcaattgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctagcagcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 7046 - RNA, 9876 nt, synthetic construct
  misc_feature 1..9876: note = derived and/or modified CDS sequence (wt) from DENV-2__KC762663__SS-prME
  source 1..9876: mol_type = other RNA
actgcaggtataattatcatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaattgaaacttgggtcttgagacatccaggcttcaccataatggcagcaatcctggcatataccataggaacaacatatttccaaagagtcctgattttcattttactgacagctgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcctgccactctaaggaagtattgtatagaggcaaagctgaccaacacaacaacagcatctcgctgcccaacacaaggagaacctagcctaaacgaagaacaggacaaaaggttcgtctgcaaacactccatggtagacagaggatggggaaatggatgcggattatttggaaagggaggcatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagagctaacaggctatggcactgtcacgatggaatgctctccgagaacgggcctcgacttcaatgagatggtgttgctgcaaatggaaaataaggcttggctggtgcacaggcaatggttcttagacctgccgttaccatggctgcccggagcagacacacaaggatcaaattggatacagaaggagacactggtcactttcaaaaacccccatgcaaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataacggacttggaaaaaagacatgttttaggtcgcttgattacagtcaacccaattgtcacagaaaaagatagcccagtcaacatagaagcagaacctccattcggagacagctacatcattataggagtagaaccgggacaactgaagctcagctggtttaagaaaggaagttctattggccaaatgtttgagacaacaatgagaggagcgaaaagaatggccattttaggtgacacagcttgggattttggatccctgggaggagtgttcacatctataggaaaggccctccaccaagtcttcggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgtgagttggaaaaacaaagaactgaaatgcggcagtgggatttttatcacagacaacgtgcacacatggacagaacaatacaaattccaaccagaatccccttcaaagctggcttcagccatccagaaggctcatgaagagggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtgttcaccactaacatatggctgaaattgaaagaaaggcaggatgcattttgtgactcaaaactcatgtcagcagccataaaagacaacagagccgttcacgccgatatgggttattggatagaaagtgcactcaacgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtagtgactgaggattgtggaaatagaggaccctccttaagaacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgatataggcatgggcgtgacttatcttgccctgttagcagccttcaaagtcagaccaacttttgcggctggactactcttaagaaagctgacctccaaggaattgatgatgaccaccataggaatcacactcctctctcagagtaccataccagagactatacttgaactgactgacgcgttggctttggggatgatggttctcaaaatagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactcgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttcctgtgtcaataccaatcacagcagctgcatggtacctgtgggaagtgaaaaaacaacgggcaggagtattgtgggatgtcccttcacccccacctgtggaaaaggccgaactggaagatggagcctatagaatcaagcagaaagggatcctaggatactcgcagattggagccggagtttacaaagaaggaacattccacacaatgtggcatgtcacacgtggtgctgtcctaatgcacaaagggaaaagaattgaaccatcatgggcggacgtcaagaaagacctaatatcgtatggaggaggctggaagctagaaggagaatggaaggaaggagaagaggtccaggtcctggcattagagcctggaaagaatccaagggccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacgctaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagccacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagaacgtgaaaaggtggatgccattgatggtgagtaccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtagactcccaaccttcatgacccagaaagcaagaaatgcactggacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaaaggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaactatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacactttgctgtgtgacataggggagtcgtcaccaaaccctacggttgaggcaggacgaacactcagagttctaaacttagtggaaaattggctgaataacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacaaatggcaatgacagacacgactccatttggacaacagcgtgtcttcaaagagaaagtggacacaagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagctctaggattcctgaatgaagatcactggttttccagagagaactccctgagtggagtggaaggagaaggactgcacaaactaggttacattttaagagacgtgagcaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcaactgacagtcacagaagaaattgcagtgaaaaactggttagtgacagtggggcgtgagaggttatcaagaatggctatcagtggagatgattgtgttgtgaaacccttggatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgagaaacagcctgtttggggaagtcctacgcccaaatgtggagcctgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaataaatcaagtcagatccctaataggcaatgaggaatacacagactacatgccatccatgaaaagattcagaagagaagaggaagaggcaggagtcttgtggtag

SEQ ID NO: 7047 - RNA, 9876 nt, synthetic construct
  misc_feature 1..9876: note = derived and/or modified CDS sequence (wt) from DENV-2__KC762675__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtactctcatggccatggaccttggtgaactgtgtgaagacacaatcacttataattgtcctctcctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacactataggaacgacacatttccaaagagtcctgatcttcatcttactgacagctgtcgctccttcaatgacaatgcgttgcataggaatatcaaatagagacttcgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaattgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggtactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcacacagcactcacaggggccacggaaatccagatgtcatcaggaaacttactgttcactggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccatgtaagatcccttttgaaataatggatttggaaaaaagacatgtcctaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacttcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcctcagctatccagaaggctcacgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaaacatggggcaaagcgaaaatgctctccacagagcttcacaaccacacctttctcattgatggccccgaaacagcagaatgtcccaacacaaacagagcttggaactcactagaagtcgaagactatggctttggagtattcaccaccaacatatggctgaaattgaaagaaaggcaggatgtatattgtgactcaaaactcatgtcagcagccataaaagataacagagccgtccacgccgatatgggttattggatagaaagcgcactcaatgacacatggaagattgagaaagcctcttttattgaagttaaaagctgctactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccactaaggtacagaggtgaggatggatgctggtatggaatggaaattagaccactgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggattactcttaagaaagctgacctccaaggaattgatgatgaccaccataggaatcgtgctcctctcccagagcaccataccagagactatacttgaactgactgacgcattggctttggggatgatggctctcaaaatagtgagaaacatggaaaagtatcaactagcagtgactatcatggccatcttgtgcgttccaaatgcagtgatattacaaaatgcatggaaagtgagctgcacaacactggcagtggtgtccgtttccccactgcttttaacatcctcacagcagaaagcggattggataccactggcgttgacgatcaaaggccttaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtactcactggaagatcggctgatttggaactggagagagctgctgacgtaagatgggaagaacaggcagagatatcaggaagtagtccaatcctgtcgataacaatatcggaagatggtagcatgtcgataaaaaatgaagaagaagaacaaacactgaccatactcatcagaacaggactgttagtgatatcaggactttttcccgtgtcaataccaatcacggcagctgcatggtacctgtgggaagtgaaaaaacaacgagcaggagtattgtgggatgtcccctcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagttagaaggagaatggaaagaaggagaagaagtccaggtcctggcattagagcctggaaagaatccaagagctgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaatttgattatcatggatgaagcccatttcacagacccagcaagcatagcagctagaggatacatttcaactcgagtagagatgggtgaagcagctgggattttcatgacagctacccctcctggaagtagagacccatttcctcagagcaatgcaccaatcatggatgaagaaagggaaatccctgagcgttcgtggaactctggacatgaatgggttacggattttaaagggaagactgtttggtttgttccaagcataaaagcagggaatgatatagcagcttgcctgagaaagaatggaaagaaagtgatacaactcagcaggaagacttttgattttgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcaagaaaaacttttgtggacctaatgagaagaggagacctaccagtctggttagcttacagagtggcagctgaaggtatcaactacgcagacagaagatggtgctttgatggagtcaagaacaaccaaatcttggaagaaaatgtggaagtggaaatttggacaaaagaaggagaaaggaagaaattgaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaatcatgctcttagtgaactgccggagactctggagacattgcttttactgacactcttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttattggtagcacattatgctatcatagggccaggactccaagcgaaagcaactagagaggctcaaaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacttggccggagccggacttctcttttctatcatgaagaacacggctaacacaagaaggggaactggcaacacaggagagacgcttggagagaaatggaaaaaccggttgaatgcattggggaagagtgaattccagatctataagaaaagtggaatccaggaggtggatagaaccttggcaaaagaaggcatcaaaagaggagaaacagaccatcatgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgtttttttcactccgccagaaaagtgtgatacattgctgtgtgacataggggagtcgtcaccaaaccccacggttgaagcaggacgaactctcagagttctaaacttagtggaaaattggctgaacaacaacacccaattttgcataaaggttctcaacccatatatgccctcagttatagaaaaaatggaagcactacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaatacaacaagagcatgaaacatcatggcattatgaccaagatcacccatacagaacgtgggcctatcatggcagctacgaaacaaaacagactggatcagcatcatccatggtgaacggagtggttaggttgctaacaaaaccttgggacgttatccctatggtgacacagatggcaatgacagatacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaacgaagatcactggttttccagagagaattccctgagtggagtggaaggagaagggctgcacaaactaggctacattttaagagacgtgagtaagaaagaaggaggagcaatgtacgctgatgacaccgcaggatgggacacaagaatcacattagaggacttaaaaaaagaagaaatggtgacaaaccacatggaaggagaacacaagaaacttgctgaagccatcttcaaattaacgtaccaaaacaaggtggtgcgtgtgcaaagaccaacgccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcaattgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcagcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaattccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagggaagaggaagaggcaggagtcttgtggtag

SEQ ID NO: 7048 - RNA, 9876 nt, synthetic construct
  misc_feature 1..9876: note = derived and/or modified CDS sequence (wt) from DENV-2__KC762671__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgctggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacgtgggtcttgagacatccaggcttcaccataatggcagcaatcctggcttacaccataggaacgacatatttccaaagagtcctgatcttcatcttactgacagctgtcgctccttcaatgacaatgcgttgtataggaatatcaaatagagactttgtggaaggggtatcaggaggaagctgggttgacatagtcttggaacatggaagctgtgtgacgacgatggcaaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggtaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactagagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacaccttcctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacagcagagccgtccacgccgatatgggttattggatagaaagcgcactcaacgacacatggaagattgagaaagcctcttttattgaagttaaaagctgccactggccaaagtcacacactctctggagtaatggagtgctagaaagtgagatgataattccaaagaactttgcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccttctttaagaacaactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtgctcctctcccaggccaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaatgcatggaaagtgagctgcacgacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctacagaatcaagcagaaagggattctaggatactcgcagatcggagctggagtttacaaagaaggaacttttcacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggtgccgtgtctctggacttttctcctggaacgtcaggatctccaatcgtcgacaaaaaaggaaaagttgtgggcctttatggcaacggtgtcgttacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagtggtggcggctgaaatggaagaagctctcagaggacttccaataagataccaaaccccagctattagagctgagcacactgggcgggagattgtggatctaatgtgtcacgccacatttaccatgaggctgctatcaccaattagagtgccaaattataacctgattatcatggatgaagcccattttacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggttacggatttcaaagggaagactgtttggtttgttccaagcataaaagcagggaatgacatagcagcttgcctgagaaagaatggaaagaaagtgatacaactcagcaggaagacttttgactttgaatatataaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggagttcgcagctggaagaaagtccctgacactgaatctaatcacagagatgggtaggctcccaaccttcatgacccagaaagcaaggaatgcactggataacttagcagtcttgcatacagccgaagcaggcggaagggcgtacaatcatgctcttagtgaactgccggagactctggagacattgcttttactgacactcttggccacagtcacgggcggaatcttcctgttcttgatgagcggaaaaggtatagggaagatgaccttgggaatgtgctgcataatcacggccagcattctcctatggtatgcacaaatacagccacactggatagcagcttcaataatattggagttttttctcatagtcttgctcattccagaaccagaaaagcagagaacgccccaagataaccaattaacttatgttgtcatagccatccttacagtggtggccgcaaccatggcaaacgagatgggttttctggaaaaaacaaagaaagatttcggactgggaagcattacaacccagcaacctgagagcaacatcctggacatagatctacgtcctgcatcagcttggactctatatgccgtggcaacaaccttcatcacaccaatgttgagacatagcattgaaaattcctcagtgaatgtgtctctaacagccattgccaaccaagccacagtgttaatgggtcttgggaaaggatggccattgtcaaagatggacatcggagttccccttctcgctatcgggtgctattcacaagtcaaccccataactctcacagcagcccttctcctattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacctggccggagccggacttctcttttctatcatgaagaacacggccaacacaagaaggggaactggcaacacgggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcatgctgtgtcgcgaggctcggcgaaactgagatggttcgtcgagagaaacctggttacaccagaagggaaagtagtggaccttggttgtggcaggggaggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccactgttgaagcaggacgaacactcagagttctaaacctagtggaaaattggctgaacaataacacccaattttgcataaaggttctcaatccatatatgccctcagtcatagaaaaaatggaagcgctacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgcgttttcaaagagaaagtggacacgagaacccaagaaccgaaagaaggcacgaaaaaactaatgaagatcacggcagaatggctctggaaagaactaggaaagaaaaagacacctaggatgtgcaccagagaagaattcgcaagaaaggtgagaagtaatgcagccttaggcgccatattcactgatgagaataagtggaagtcggcacgtgaggctgttgaagacagcggattttgggaactggttgacaaggaaaggaatctccatcttgaaggaaagtgtgagacatgcgtatataacatgatgggaaagagagagaagaaactaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtatgaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaactaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggctagtaagagtggggcgtgagaggttatcaagaatggccattagtggagatgattgtgttgtgaaacccttagatgacaggtttgcaagcgctctaacagctctaaatgacatgggaaaggttaggaaagacatacaacaatgggaaccttcaagaggatggaacgactggacacaagtgcctttttgttcacaccatttccatgagttaatcatgaaggacggtcgtgtactcgtagttccatgcagaaatcaagatgaactgattggtagggcccgaatatcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctaacagtttggaacagggtgtggattcaagaaaacccatggatggaagacaaaactccagtggaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggtttagaagagaagaggaagaggcaggagtcttgtggtag

SEQ ID NO: 7049 - RNA, 9876 nt, synthetic construct
  misc_feature 1..9876: note = derived and/or modified CDS sequence (wt) from DENV-2__KC762664__SS-prME
  source 1..9876: mol_type = other RNA
actgcaggtataattatcatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaattgaaacttgggtcttgagacatccaggcttcaccataatggcagcaatcctggcatataccataggaacaacatatttccaaagagtcctgattttcattttactgacagctgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcctgccactctaaggaagtattgtatagaggcaaagctgaccaacacaacaacagcatctcgctgcccaacacaaggagaacctagcctaaacgaagaacaggacaaaaggttcgtctgcaaacactccatggtagacagaggatggggaaatggatgcggattatttggaaagggaggcatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagagctaacaggctatggcactgtcacgatggaatgctctccgagaacgggcctcgacttcaatgagatggtgttgctgcaaatggaaaataaggcttggctggtgcacaggcaatggttcttagacctgccgttaccatggctgcccggagcagacacacaaggatcaaattggatacagaaggagacactggtcactttcaaaaacccccatgcaaagaaacaggatgttgttgttttaggatcccaagaaggggctatgcatacagcactcacaggggccacggaaatccagatgtcatcaggaaatttactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataacggacttggaaaaaagacatggtttaggtcgcttgattacagtcaacccaattgtcacagaaaaagatagcccagtcaacatagaagcagaacctccattcggagacagctacattattataggagtagaaccgggacaactgaagctcagctggtttaagaaaggaagttctattggccaaatgtttgagacaacaatgagaggagcgaaaagaatggccattttaggtgacacagcttgggattttggatccctgggaggagtgttcacatctataggaaaggccctccaccaagtcttcggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgtgagttggaaaaacaaagaactgaaatgcggcagtgggatttttatcacagacaacgtgcacacatggacagaacaatacaaattccaaccagaatccccttcaaagctggcttcagccatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtgttcaccactaacatatggctgaaattgaaagaaaggcaggatgcattttgtgactcaaaactcatgtcagcagccataaaagacaacagagccgttcacgccgatatgggttattggatagaaagcgcactcaacgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccatacacaaacggcaggaccctggcatctaggtaggcttgagatggactttgatttctgcgaaggaaccacagtggtagtgactgaggattgtggaaatagaggaccctccttaagaacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgatataggcatgggcgtgacttatcttgccctgttagcagccttcaaagtcagaccaacttttgcggctggactactcttaagaaagctgacctccaaggaattgatgatgaccaccataggaatcacactcctctctcagagtaccataccagagactatacttgaactgactgacgcgttggctttggggatgatggttctcaaaatagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactcgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttcctgtatcaataccaatcacagcagctgcatggtacctgtgggaagtgaaaaaacaacgggcaggagtattgtgggatgtcccttcacccccacctgtggaaaaggccgaactggaagatggagcctatagaatcaagcagaaagggatcctaggatactcgcagattggagccggagtttacaaagaaggaacattccacacaatgtggcatgtcacacgtggtgctgtcctaatgcacaaagggaaaagaattgaaccatcatgggcggacgtcaagaaagacctaatatcgtatggaggaggctggaagctagaaggagaatggaaggaaggagaagaggtccaggtcctggcattagagcctggaaagaatccaagagccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacgctaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtaaagcagctggtattttcatgacagccacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggcagactcccaaccttcatgacccagaaagcaagaaatgcactggacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaaaggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaactatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcctattggtagcacattatgctatcatagggccaggactccaagcgaaagcaaccagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacactttgctgtgtgacataggggagtcgtcaccaaaccctacggttgaggcaggacgaacactcagagttctaaacttagtggaaaattggctgaataacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccgaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacaaatggcaatgacagacacgactccatttggacaacagcgtgtcttcaaagagaaagtggacacaagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagctctaggattcctgaatgaagatcactggttttccagagagaactccctgagtggagtggaaggagaaggactgcacaaactaggttacattttaagagacgtgagcaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcaactgacagtcacagaagaaattgcagtgaaaaactggttagtgacagtggggcgtgagaggttatcaagaatggctatcagtggagatgattgtgttgtgaaacccttggatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgagaaacagcctgtttggggaagtcctacgcccaaatgtggagcctgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtaggatcatgggaggaaatcccgtatttggggaaaagagaagaccaatggtgcggctcactgattgggctaacaagcagggctacctgggcaaagaacatccaaacagcaataaatcaagtcagatccctaataggcaatgaggaatacacagactacatgccatccatgaaaagattcagaagagaagaggaagaggcaggagtcttgtggtag

SEQ ID NO: 7050 - RNA, 9876 nt, synthetic construct
  misc_feature 1..9876: note = derived and/or modified CDS sequence (wt) from DENV-2__KC762674__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtactctcatggccatggaccttggtgaactgtgtgaagacacaatcacttataattgtcctctcctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacactataggaacgacacatttccaaagagtcctgatcttcatcttactgacagctgtcgctccttcaatgacaatgcgttgcataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaattgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggtactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcatacagcactcacaggggccacggaaatccagatgtcatcaggaaacttactgttcactggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccatgtaagatcccttttgaaataatggatttggaaaaaagacatgtcctaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacttcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcctcagctatccagaaggctcacgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaaacatggggcaaagcgaaaatgctctccacagagcttcacaaccacacctttctcattgatggccccgaaacagcagaatgtcccaacacaaacagagcttggaactcactagaagtcgaagactatggctttggagtattcaccaccaacatatggctgaaattgaaagaaaggcaggacgtatattgtgactcaaaactcatgtcagcagccataaaagataacagagccgtccacgctgatatgggttattggatagaaagtgcactcaatgacacatggaagattgagaaagcctcttttattgaagttaaaagctgctactggccaaagtcacacaccctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccactaaggtacagaggtgaggatggatgctggtatggaatggaaattagaccactgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggattactcttaagaaagctgacctccaaggaattgatgatgaccaccataggaatcgtgctcctctcccagagcaccataccagagactatacttgaactgactgacgcattggctttggggatgatggctctcaaaatagtgagaaacatggaaaagtatcaactagcagtgactatcatggccatcttgtgcgttccaaatgcagtgatattacaaaacgcatggaaagtgagctgcacaacactggcagtggtgtccgtttccccactgcttttaacatcctcacagcagaaagcggattggataccactggcgttgacgatcaaaggccttaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtactcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttagtgatatcaggactttttcccgtatcaataccaatcacggcagctgcatggtacctgtgggaagtgaaaaaacaacgagcaggagtattgtgggatgtcccctcacccccacctgtgggaaaagccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagttagaaggagaatggaaagaaggagaagaagtccaggtcctggcattagagcctggaaagaatccaagagctgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagtatcgaagacaatccagagattgaagatgacatctttcgaaagaaaagattgaccatcatggacctccacccaggagcaggaaaaacaaagagataccttccagcaatagtcagagaagccataaaacgaggcttgagaacgctaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacttgattatcatggatgaagcccatttcacagacccagcaagcatagcagctagaggatacatttcaactcgagtagagatgggtgaagcagctgggattttcatgacagctacccctcctggaagtagagacccatttcctcagagcaatgcaccaatcatggatgaagaaagggaaatccctgagcgttcgtggaactctggacatgaatgggttacggattttaaagggaagactgtttggtttgttccaagcataaaagcagggaatgatatagcagcttgcctgagaaagaatggaaagaaagtgatacaactcagcaggaagacttttgattttgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagccaaaatgcttctagacaacatcaacacgcctgaaggaatcattcccagcatgttcgaaccagagcgtgaaaaggtggatgccattgatggtgaataccgcttgagaggagaagcaagaaaaacttttgtggacctaatgagaagaggagacctaccagtctggttagcctacagagtggcagctgaaggtatcaactacgcagacagaagatggtgctttgatggagtcaagaacaaccaaatcttggaagaaaatgtggaagtggaaatttggacaaaagaaggagaaaggaagaaattgaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaatcatgctcttagtgaactgccggagactctggagacattgcttttactgacactcttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcattacaacccagcaacctgagagcaatatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttattggtagcacattatgctatcatagggccaggactccaagcgaaagcaactagagaggctcaaaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacttggccggagccggacttctcttttctatcatgaagaacacggctaacacaagaaggggaactggcaacacaggagagacgcttggagagaaatggaaaaaccggttgaatgcattggggaagagtgaattccagatctataagaaaagtggaatccaggaagtggatagaaccttggcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgtttttttcactccgccagaaaagtgtgatacattgctgtgtgacataggggagtcgtcaccaaaccccacggttgaagcaggacgaactctcagagttctaaacttagtggaaaattggctgaacaacaacacccaattttgcataaaggttcttaacccatatatgccctcagttatagaaaaaatggaagcactacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaataaaacaagagcatgaaacatcatggcattatgaccaagatcacccatacaaaacgtgggcctatcatggcagctacgaaacaaaacagactggatcagcatcatccatggtgaacggagtggttaggttgctaacaaaaccttgggacgttatccctatggtgacacagatggcaatgacagatacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagtttggcaaagcgaaaggcagcagagccatatggtacatgtggcttggagcacgcttcttagagtttgaagccctaggattcttgaacgaagatcactggttttccagagagaactccctgagtggagtggaaggagaagggctgcacaaactaggctacattttaagagacgtgagtaagaaagaaggaggagcaatgtacgctgatgacaccgcaggatgggacacaagaatcacattagaggacttaaaaaacgaagaaatggtgacaaaccacatggaaggagaacacaagaaacttgctgaagccatcttcaaattaacgtaccaaaacaaggtggtgcgtgtgcaaagaccaacgccaagaggcacagtgatggacattatatcgagaagagaccaaagaggtagcggacaagttgtcacctacggcctcaatactttcaccaacatggaagcccaactgatcagacagatggagggagaaggagtcttcaaaagcatccagcaattgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcagcaaatgccatttgctcggcagtcccatcacactgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaattccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 7051 - RNA, 9876 nt, synthetic construct
  misc_feature 1..9876: note = derived and/or modified CDS sequence (wt) from DENV-2__KC762672__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgctggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacgtgggtcttgagacatccaggcttcaccataatggcagcaatcctggcttacaccataggaacgacatatttccaaagagtcctgatcttcatcttactgacagctgtcgctccttcaatgacaatgcgttgtataggaatatcaaatagagactttgtggaaggggtatcaggaggaagctgggttgacatagtcttggaacatggaagctgtgtgacgacgatggcaaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggtaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttgggaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactagagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacaccttcctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacagcagagccgtccacgccgatatgggttattggatagaaagcgcactcaacgacacatggaagattgagaaagcctcttttattgaagttaaaagctgccactggccaaagtcacacactctctggagtaatggagtgctagaaagtgagatgataattccaaagaactttgcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccttctttaagaacaactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtgctcctctcccaggccaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaatgcatggaaagtgagctgcacgacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctacagaatcaagcagaaagggattctaggatactcgcagatcggagctggagtttacaaagaaggaacttttcacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggtgccgtgtctctggacttttctcctggaacgtcaggatctccaatcgtcgacaaaaaaggaaaagttgtgggcctttatggcaacggtgtcgttacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagtggtggcggctgaaatggaagaagctctcagaggacttccaataagataccaaaccccagctattagagctgagcacactgggcgggagattgtggatctaatgtgtcacgccacatttaccatgaggctgctatcaccaattagagtgccaaattataacctgattatcatggatgaagcccattttacagacccagcaagcatagcagctagaggatacatttcaactcgagtagagatgggtgaagcagctgggattttcatgacagccacccctcccggaagcagagacccatttcctcagagcaatgcaccaatcatggatgaagaaagggaaatccctgagcgttcgtggaactctggacatgagtgggttacggatttcaaagggaagactgtttggtttgttccaagcataaaagcagggaatgacatagcagcttgcctgagaaagaatggaaagaaagtgatacaactcagcaggaagacttttgactttgaatatataaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggagttcgcagctggaagaaagtccctgacactgaatctaatcacagagatgggtaggctcccaaccttcatgacccagaaagcaaggaatgcactggataacttagcagtcttgcatacagccgaagcaggcggaagggcgtacaatcatgctcttagtgaactgccggagactctggagacattgcttttactgacactcttggccacagtcacgggcggaatcttcctgttcttgatgagcggaaaaggtatagggaagatgaccttgggaatgtgctgcataatcacggccagcattctcctatggtatgcacaaatacagccacactggatagcagcttcaataatattggagttttttctcatagtcttgctcattccagaaccagaaaagcagagaacgccccaagataaccaattaacttatgttgtcatagccatccttacagtggtggccgcaaccatggcaaacgagatgggttttctggaaaaaacaaagaaagatttcggactgggaagcattacaacccagcaacctgagagcaacatcctggacatagatctacgtcctgcatcagcttggactctatatgccgtggcaacaaccttcatcacaccaatgttgagacatagcattgaaaattcctcagtgaatgtgtctctaacagccattgccaaccaagccacagtgttaatgggtcttgggaaaggatggccattgtcaaagatggacatcggagttccccttctcgctatcgggtgctattcacaagtcaaccccataactctcacagcagcccttctcctattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacctggccggggccggacttctcttttctatcatgaagaacacggccaacacaagaaggggaactggcaacgcgggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcatgctgtgtcgcgaggctcggcgaaactgagatggttcgtcgagagaaacctggttacaccagaagggaaagtagtggaccttggttgtggcaggggaggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccactgttgaagcaggacgaacactcagagttctaaacctagtggaaaattggctgaacaataacacccaattttgcataaaggttctcaatccatatatgccctcagtcatagaaaaaatggaagcgctacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgcgttttcaaagagaaagtggacacgagaacccaagaaccgaaagaaggcacgaaaaaactaatgaagatcacggcagaatggctctggaaagaactaggaaagaaaaagacacctaggatgtgcaccagagaagaattcgcaagaaaggtgagaagtaatgcagccttaggcgccatattcactgatgagaataagtggaagtcggcacgtgaggctgttgaagacagcggattttgggaactggttgacaaggaaaggaatctccatcttgaaggaaagtgtgagacatgcgtatataacatgatgggaaagagagagaagaaactaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtatgaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaactaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggctagtaagagtggggcgtgagaggttatcaagaatggccattagtggagatgattgtgttgtgaaacccttagatgacaggtttgcaagcgctctaacagctctaaatgacatgggaaaggttaggaaagacatacaacaatgggaaccttcaagaggatggaacgactggacacaagtgcctttttgttcacaccatttccatgagttaatcatgaaggacggtcgtgtactcgtagttccatgcagaaatcaagatgaactgattggtagggcccgaatatcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctaacagtttggaacagggtgtggattcaagaaaacccatggatggaagacaaaactccagtggaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggtttagaagagaagaggaagaggcaggagtcttgtggtag

SEQ ID NO: 7052 - RNA, 9876 nt, synthetic construct
  misc_feature 1..9876: note = derived and/or modified CDS sequence (wt) from DENV-2__KC762667__SS-prME
  source 1..9876: mol_type = other RNA
actgcaggtataattatcatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggatcttggtgaactgtgtgaagacacaatcacttacaattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaattgaaacttgggtcttgagacatccaggcttcaccataatggcagcaatcctggcatataccataggaacaacatatttccaaagagtcctgattttcattttactgacagccgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaacgaagaacaggacaaaaggttcgtctgcaaacactccatggtagacagaggatggggaaatggatgcggattatttggaaagggaggcatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaattcagatgtcatcaggaaacttactgtttacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgttttaggtcgcttgattacagtcaacccaattgtcacagaaaaagatagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtcttcggagctatctatggggctgccttcagtggggtttcatggactatgaaaatcctcataggagtcgtcatcacatggataggaatgaattcacgcagcacctcactgtctgtgtcactagtattagtgggggtcgtgacattgtatctgggagtcatggtgcaggccgatagtggttgcgttgtgagttggaaaaacaaagaactgaaatgcggcagtgggatttttatcacagacaacgtgcacacatggacagaacaatacaaattccaaccagaatccccttcaaagctggcttcagccatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtattcaccactaacatatggctgaaattgaaagaaaggcaggatgcattttgtgactcaaaactcatgtcagcagccataaaagacaacagagccgtccacgccgatatgggttattggatagaaagtgcactcaacgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggattgtggaaatagaggaccctccttaagaacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatctcgccctattagcagccttcaaagtcagaccaacttttgcggctggactactcttaagaaagctgacctccaaggaattgatgatgaccaccataggagtcacactcctctctcagagtaccataccagagactatacttgaactgactgacgcgttggctttggggatgatggttctcaaaatagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccacttgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttcctgtatcaataccaatcacagcagctgcatggtacctgtgggaagtgaaaaaacaacgggcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaagagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagccatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagctacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtagactcccaaccttcatgacccagaaagcaaggaatgcactggacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaaaggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcataacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggactcctcttttctatcatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggttacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacactttgctgtgtgacataggggagtcgtcaccaaaccctacggttgaggcaggacgaacactcagagttctaaacttagtggaaaattggctgaataacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagctacatacgagccagatgttgacctcggaagtggaacccgcaacatcggaattgaaagtgagacaccaaatttagacataattgggaaaagaatagaaaaaataaaacgagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacaaatggcaatgacagacacgactccatttggacaacagcgcgtcttcaaagagaaagtggacacaagaacccaagaaccgaaagaaggcacaaaaaaactaatgaaaatcacggcagaatggctctggaaagaactaggaaagaaaaagacacctaggatgtgcactagagaagaattcacaagaaaggtgagaagcaatgcagccttaggtgccatattcactgatgagaacaagtggaagtcagcacgtgaggctgttgaagacagtggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagctctaggattcctgaatgaagatcactggttttccagagagaactccctgagtggagtggaaggagaaggactgcacaaactaggctacattttaagagacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcacctgacagtcacagaagaaattgcagtgaaaaactggttagtgagagtggggcgtgagaggttatcaagaatggctatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttgggaaagtcctacgcccaaatgtggagcctgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaataaatcaagtcagatccctaataggcaatgaggaatacacagactacatgccatccatgaaaagattcagaagagaagaggaagaggcaggagtcttgtggtag

SEQ ID NO: 7053 - RNA, 9876 nt, synthetic construct
  misc_feature 1..9876: note = derived and/or modified CDS sequence (wt) from DENV-2__KC762659__SS-prME
  source 1..9876: mol_type = other RNA
actgcaggtataattattatgatgatcccaacagtgatggcgttccatttaaccacacgcaacggagaaccacacatgatcgtcagtagacaagagaaggggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcatacaccataggaacaacatatttccaaagagtcctgattttcattttactcacagctgtcactccttcaatgacaatgcgttgtataggaatatcaaatagagactttgtggaaggggtttcaggaggaagctgggttgacatagtcttggaacatggaagctgtgtgacgacgatggcgaaaaataaaccaacactggatttcgaattgataaaaacagaagccaaacatcccgctactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaataaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttgctgttcacaggacatcttaagtgcaggctgagaatggacaaactacagcttaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgtcttaggtcgcttgattacagttaacccaattgtcacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattctaggtgacacagcttgggattttggatccctaggaggagtgttcacatctataggaaaggccctccaccaagtctttggagctatctatggggctgccttcagtggggtttcatggactatgaaaatcctcataggagtcgtcatcacgtggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatatttatcacagacaacgtgcacacatggacagaacaatacaaatttcaaccagagtccccttcaaagctggcttcagctatccagaaggctcatgaggaaggcatttgtggaatccgctcagtaacaagactggagaatctgatgtggaaacaaataacaccagaattgaatcacatcctatcagaaaatgaggtaaagttgactatcatgacaggagacattaaaggaatcatgcaggcaggaaaacgatctctgcgacctcaacccactgagctgaagtactcttggaaaacatggggcaaagcgaaaatgctttccacagagcttcataaccacacctttctcattgatggccccgaaacagcagaatgtcccaacacaaacagagcttggaattcactagaagttgaagactatggctttggagtattcaccactaacatatggctgaaattgaaagaaaggcaggatgtattttgtgactcaaaactcatgtcagcagccataaaagacaacagagccgtccacgccgatatgggttattggatggaaagcgcactcaatgacacatggaagattgagaaagcctcttttattgaagttaaaagctgccactggccaaagtcacacactctttggagtaatggagtgctggaaagtgagatgataattccaaagaattttgcaggaccagtgtcacaacacaattacagaccaggctatcatacacaaacggcaggaccctggcatctaggcaggcttgagatggactttgatttctgtgaaggaaccacagtggtggtgactgaggactgtggaaatagaggaccctccttaagaacaactactgcttctggaaaacttataacagagtggtgctgtcgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcgatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggattactcttaagaaggctgacctccaaggaattgatgatgaccaccataggaatcgtactcctctctcagagtaccataccagagactatacttgaactgactgacgcgttggctttggggatgatggttctcaaaatagtgagaaaaatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttccggtgtcaataccaatcacggcagctgcatggtacctgtgggaagtgaaaaagcaacgagcaggagtattgtgggatgtcccttcacccccacctgtgggaaaggccgaactggaagatggagcctatagaatcaagcagaaagggattctaggatactcgcagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaaccaatactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaggatgacatctttcgaaagaaaagattgaccatcatggacctccacccaggagcaggaaaaacaaagagataccttccagcaatagtcagagaagccataaaacgaggcttgaggacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgaagaaagagaaatccctgagcgttcgtggaactctggacatgagtgggttacggattttaaagggaagactgtttggttcgttccaagtataaaagcagggaatgacatagcagcttgcctgagaaagaatggaaagaaagtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccactctagtgcagcacaaagaagagggagagtgggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagagcgtgaaaaggtggatgccattgatggtgaataccgcctgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaaaaaattaaaacccagatggctggatgctaggatctactctgacccactggcgctcaaagaattcaaggaattcgcagctggaagaaagtccctgaccctgaatctaatcacagagatgggtagactcccaaccttcatgacccagaaagcaaggaatgcactggacaacttagcagtcctgcatacggctgaagcaggcggaagggcgtacaatcatgctcttagtgaactgccggagactctggagacattacttttactgacactcttggccacagtcacgggcggaatcttcctgttcttgatgagcggaaagggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcattacaacccagcaatctgaaagtaacatcctggacatagatctacgtcctgcatcagcttggactctatatgccgtagcaacaactttcatcacaccaatgttgaggcatagcattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacttagacccaataccctatgatccaaagtttgagaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggcaggagccggacttctcttttccatcatgaaaaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggtatcaaaagaggagaaacggaccatcacgctgtgtcgcgaggctcagcgaagctgagatggttcgtcgagagaaacctggtcacaccagaagggaaagtagtggaccttggctgcggtagggggggctggtcatactattgtgggggactaaagaatgtaaaagaagttaaaggcctaacaaaaggaggaccaggacacgaagaacccattcccatgtcaacatatggttggaatctggtacgtcttcaaagtggagttgatgttttttttactccaccagaaaagtgcgacacattactgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcgctacaaaggaaatacggaggagctttggtgaggaatccactctcacgaaattccacacacgagatgtactgggtatctaatgcttccgggaacatagtgtcatcagtgaacatgatttcaagaatgctgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccctgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctttggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggctcggagcacgcttcttagagtttgaagctctaggatttttgaatgaagatcactggttttctagagagaactccctgagtggagtggaaggagaagggctgcacaaactaggctacattttaagagacgtgagcaagaaagaaggaggagcaatgtatgccgatgacaccgcaggatgggacacaagaatcacactagaggacctaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggaaggagaaggagtcttcaaaagcatccagcaactgacagccacagaagaaattgcagtgaaaaactggttagtaagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtttggggaagtcctacgcccaaatgtggagcctgatgtactttcacagacgtgaccttaggctggcggcaaatgccatttgctcagcggtcccatcacattgggttccaacaagtcgaacaacctggtccatacacgccacacatgagtggatgacaacagaagacatgctgacagtctggaacagggtgtggattcaagaaaacccatggatagaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7054 - RNA, 9876 nt, synthetic construct
  misc_feature 1..9876: note = derived and/or modified CDS sequence (wt) from DENV-2__KC762657__SS-prME
  source 1..9876: mol_type = other RNA
actgcaggtataattattatgatgatcccaacagtgatggtgttccatttaaccacacgcaacggagaaccacacatgatcgtcagtagacaagagaaggggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcatacaccataggaacaacatatttccaaagagtcctgattttcattttactcacagctgtcactccttcaatgacaatgcgttgtataggaatatcaaatagagactttgtggaaggggtttcaggaggaagctgggttgacatagtcttggaacatggaagctgtgtgacgacgatggcgaaaaataaaccaacactggatttcgaattgataaaaacagaagccaaacatcccgctactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaataaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttgctgttcacaggacatcttaagtgcaggctgagaatggacaaactacagcttaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgtcttaggtcgcttgattacagttaacccaattgtcacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattctaggtgacacagcttgggattttggatccctaggaggagtgttcacatctataggaaaggccctccaccaagtctttggagctatctatggggctgccttcagtggggtttcatggactatgaaaatcctcataggagtcgtcatcacgtggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatatttatcacagacaacgtgcacacatggacagaacaatacaaatttcaaccagagtccccttcaaagctggcttcagctatccagaaggctcatgaggaaggcatttgtggaatccgctcagtaacaagactggagaatctgatgtggaaacaaataacaccagaattgaatcacatcctatcagaaaatgaggtaaagttgactatcatgacaggagacattaaaggaatcatgcaggcaggaaaacgatctctgcgacctcaacccactgagctgaagtactcttggaaaacatggggcaaagcgaaaatgctttccacagagcttcataaccacacctttctcattgatggccccgaaacagcagaatgtcccaacacaaacagagcttggaattcactagaagttgaagactatggctttggagtattcaccactaacatatggctgaaattgaaagaaaggcaggatgtattttgtgactcaaaactcatgtcagcagccataaaagacaacagagccgtccacgccgatatgggttattggatggaaagcgcactcaatgacacatggaagattgagaaagcctcttttattgaagttaaaagctgccactggccaaagtcacacactctttggagtaatggagtgctggaaagtgagatgataattccaaagaattttgcaggaccagtgtcacaacacaattacagaccaggctatcatacacaaacggcaggaccctggcatctaggcaggcttgagatggactttgatttctgtgaaggaaccacagtggtggtgactgaggactgtggaaatagaggaccctccttaagaacaactactgcttctggaaaacttataacagagtggtgctgtcgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcgatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggattactcttaagaaggctgacctccaaggaattgatgatgaccaccataggaatcgtactcctctctcagagtaccataccagagactatacttgaactgactgacgcgttggctttggggatgatggttctcaaaatagtgagaaaaatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttccggtgtcaataccaatcacggcagctgcatggtacctgtgggaagtgaaaaagcaacgagcaggagtattgtgggatgtcccttcacccccacctgtgggaaaggccgaactggaagatggagcctatagaatcaagcagaaagggattctaggatactcgcagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaaccaatactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaggatgacatctttcgaaagaaaagattgaccatcatggacctccacccaggagcaggaaaaacaaagagataccttccagcaatagtcagagaagccataaaacgaggcttgaggacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaatgcaccaatcatggatgaagaaagagaaatccctgagcgttcgtggaactctggacatgagtgggttacggattttaaagggaagactgtttggtttgttccaagtataaaagcagggaatgacatagcagcttgcctgagaaagaatggaaagaaagtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccactctagtgcagcacaaagaagagggagagtgggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagagcgtgaaaaggtggatgccattgatggtgaataccgcctgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaaaaaattaaaacccagatggctggatgctaggatctactctgacccactggcgctcaaagaattcaaggaattcgcagctggaagaaagtccctgaccctgaatctaatcacagagatgggtagactcccaaccttcatgacccagaaagcaaggaatgcactggacaacttagcagtcctgcatacggctgaagcaggcggaagggcgtacaatcatgctcttagtgaactgccggagactctggagacattacttttactgacactcttggccacagtcacgggcggaatcttcctgttcttgatgagcggaaagggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcattacaacccagcaatctgaaagtaacatcctggacatagatctacgtcctgcatcagcttggactctatatgccgtagcaacaactttcatcacaccaatgttgaggcatagcattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaactagagaggctcagaaaagagcagcagcgggcatcatgaaaaacccaactgtggatggaataacagtgattgacttagacccaataccctatgatccaaagtttgagaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggcaggagccggacttctcttttccatcatgaaaaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggtatcaaaagaggagaaacggaccatcacgctgtgtcgcgaggctcagcgaagctgagatggttcgtcgagagaaacctggtcacaccagaagggaaagtagtggaccttggctgcggtagggggggctggtcatactattgtgggggactaaagaatgtaaaagaagttaaaggcctaacaaaaggaggaccaggacacgaagaacccattcccatgtcaacatatggttggaatctggtacgtcttcaaagtggagttgatgttttttttactccaccagaaaagtgcgacacattactgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcgctacaaaggaaatacggaggagctttggtgaggaatccactctcacgaaattccacacacgagatgtactgggtatctaatgcttccgggaacatagtgtcatcagtgaacatgatttcaagaatgctgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccctgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctttggaaagaattaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggctcggagcacgcttcttagagtttgaagctctaggatttttgaatgaagatcactggttttctagagagaactccctgagtggagtggaaggagaagggctgcacaaactaggctacattttaagagacgtgagcaagaaagaaggaggagcaatgtatgccgatgacaccgcaggatgggacacaagaatcacactagaggacctaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggaaggagaaggagtcttcaaaagcatccagcacctgacagccacagaagaaattgcagtgaaaaactggttagtaagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtttggggaagtcctacgcccaaatgtggagcctgatgtactttcacagacgtgaccttaggctggcggcaaatgccatttgctcagcggtcccatcacattgggttccaacaagtcgaacaacctggtccatacacgccacacatgagtggatgacaacagaagacatgctgacagtctggaacagggtgtggattcaagaaaacccatggatagaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7055 - RNA, 9876 nt, synthetic construct
  misc_feature 1..9876: note = derived and/or modified CDS sequence (wt) from DENV-2__KC762666__SS-prME
  source 1..9876: mol_type = other RNA
actgcaggtataattatcatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggatcttggtgaactgtgtgaagacacaatcacttacaattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaattgaaacttgggtcttgagacatccaggcttcaccataatggcagcaatcctggcatataccataggaacaacatatttccaaagagtcctgattttcattttactgacagccgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaacgaagaacaggacaaaaggttcgtctgcaaacactccatggtagacagaggatggggaaatggatgcggattatttggaaagggaggcatcgtgacctgtgcaatgttcacatgcaaaaagaacatggaaggaaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaattcagatgtcatcaggaaacttactgtttacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgttttaggtcgcttgattacagtcaacccaattgtcacagaaaaagatagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtcttcggagctatctatggggctgccttcagtggggtttcatggactatgaaaatcctcataggagtcgtcatcacatggataggaatgaattcacgcagcacctcactgtctgtgtcactagtattagtgggggtcgtgacattgtatctgggagtcatggtgcaggccgatagtggttgcgttgtgagttggaaaaacaaagaactgaaatgcggcagtgggatttttatcacagacaacgtgcacacatggacagaacaatacaaattccaaccagaatccccttcaaagctggcttcagccatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtattcaccactaacatatggctgaaattgaaagaaaggcaggatgcattttgtgactcaaaactcatgtcagcagccataaaagacaacagagccgtccacgccgatatgggttattggatagaaagtgcactcaacgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggattgtggaaatagaggaccctccttaagaacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatctcgccctattagcagccttcaaagtcagaccaacttttgcggctggactactcttaagaaagctgacctccaaggaattgatgatgaccaccataggaatcacactcctctctcagagtaccataccagagactatacttgaactgactgacgcgttggctttggggatgatggttctcaaaatagtgagaaacatggaaaagtaccaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccacttgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaaaaatgaagaagaagaacaaacactgaccatactcattagaacaggactgctggtgatatcaggactttttcctgtatcaataccaatcacagcagctgcatggtacctgtgggaagtgaaaaaacaacgggcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaagagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagccatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagctacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaactcagcaggaagacttttgattttgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtagactcccaaccttcatgacccagaaagcaaggaatgcactggacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaaaggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcataacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttaatgggtcttgggaaaggatggccattatcaaaaatggacatcggagttccccttctcgctatcgggtgctattcacaagtcaaccccataactctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggactcctcttttctatcatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggttacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacactttgctgtgtgacataggggagtcgtcaccaaaccctacggttgaggcaggacgaacactcagagttctaaacttagtggaaaattggctgaataacaacacccaattttgcataaaggttctcaacccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacgagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacaaatggcaatgacagacacgactccatttggacaacagcgcgtcttcaaagagaaagtggacacaagaacccaagaaccgaaagaaggcacaaaaaaactaatgaaaatcacggcagaatggctctggaaagaactaggaaagaaaaagacacctaggatgtgcactagagaagaattcacaagaaaggtgagaagcaatgcagccttaggtgccatattcactgatgagaacaagtggaagtcagcacgtgaggctgttgaagacagtggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagctctaggattcctgaatgaagatcactggttttccagagagaactccctgagtggagtggaaggagaaggactgcacaaactaggctacattttaagagacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcaactgacagtcacagaagaaattgcagtgaaaaactggttagtgagagtggggcgtgagaggttatcaagaatggctatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttgggaaagtcctacgcccaaatgtggagcctgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaataaatcaagtcagatccctaataggcaatgaggaatacacagactacatgccatccatgaaaagattcagaagagaagaggaagaggcaggagtcttgtggtag

SEQ ID NO: 7056 - RNA, 9876 nt, synthetic construct
  misc_feature 1..9876: note = derived and/or modified CDS sequence (wt) from DENV-2__KC762677__SS-prME
  source 1..9876: mol_type = other RNA
actgcaggtataattattatgatgattccaacagtgatggcgttccatttaaccacacgcaatggagaaccacacatgatcgtcagtagacaagagaaagggaaaagtcttctgtttaaaacagagaacggtgtgaacatgtgtactctcatggccatggaccttggtgaactgtgtgaagacacaatcacttataattgtcctctcctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacactataggaacgacacatttccaaagagtcctgatcttcatcttactgacagctgtcgctccttcaatgacaatgcgttgcataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaattgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggtactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcacacagcactcacaggggccacggaaatccagatgtcatcaggaaacttactgttcactggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccatgtaagatcccttttgaaataatggatttggaaaaaagacatgtcctaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacttcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcctcagctatccagaaggctcacgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaaacatggggcaaagcgaaaatgctctccacagagcttcacaaccacacctttctcattgatggccccgaaacagcagaatgtcccaacacaaacagagcttggaactcactagaagtcgaagactatggctttggagtattcaccaccaacatatggctgaaattgaaagaaaggcaggatgtatattgtgactcaaaactcatgtcagcagccataaaagataacagagccgtccacgccgatatgggttattggatagaaagcgcactcaatgacacatggaagattgagaaagcctcttttattgaagttaaaagctgctactggccaaagtcacacaccctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccactaaggtacagaggtgaggatggatgctggtatggaatggaaattagaccaatgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggattactcttaagaaagctgacctccaaggaattgatgatgaccaccataggaatcgtgctcctctcccagagcaccataccagagactatacttgaactgactgacgcattggctttggggatgatggctctcaaaatagtgagaaacatggaaaagtatcaactagcagtgactatcatggccatcttgtgcgttccaaatgcagtgatattacaaaacgcatggaaagtgagctgcacaacactggcagtggtgtccgtttccccactgcttttaacatcctcacagcagaaagcggattggataccactggcgttgacgatcaaaggccttaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtactcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttagtgatatcaggactttttcctgtatcaataccaatcacggcagctgcatggtacctgtgggaagtgaaaaaacaacgagcaggagtattgtgggatgtcccctcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagttagaaggagaatggaaagaaggagaagaagtccaggtcctggcattagagcctggaaagaatccaagagctgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacttgattatcatggatgaagcccatttcacagacccagcaagcatagcagctagaggatacatttcaactcgagtagagatgggtgaagcagctgggattttcatgacagctacccctcctggaagtagagacccatttcctcagagcaatgcaccaatcatggatgaagaaagggaaatccctgagcgttcgtggaactctggacatgaatgggttacggattttaaagggaagactgtttggtttgttccaagcataaaagcagggaatgatatagcagcttgcctgagaaagaatggaaagaaagtgatacaactcagcaggaagacttttgattttgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcaagaaaaacttttgtggacctaatgagaagaggagacctaccagtctggttagcctacagagtggcagctgaaggtatcaactacgcagacagaagatggtgctttgatggagtcaagaacaaccaaatcttggaagaaaatgtggaagtggaaatttggacaaaagaaggagaaaggaagaaattgaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaaccatgctcttagtgaactgccggagactctggagacattgcttttactgacactcttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcattacaacccagcaacctgagagcaatatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttattggtagcacattatgctatcatagggccaggactccaagcgaaagcaactagagaggctcaaaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacttggccggagccggacttctcttttctatcatgaagaacacggctaacacaagaaggggaactggcaacacaggagagacgcttggagagaaatggaaaaaccggttgaatgcattggggaagagtgaattccagatctataaaaaaagtggaatccaggaagtggatagaaccttggcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggctggaatctggtgcgtcttcaaagtggagttgatgtttttttcactccgccagaaaagtgtgatacattgctgtgtgacataggggagtcgtcaccaaaccccacggttgaagcaggacgaactctcagagttctaaacttagtggaaaattggctgaacaacaacacccaattttgcataaaggttctcaacccatatatgccctcagttatagaaaaaatggaagcactacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaataaaacaagagcatgaaacatcatggcattatgaccaagatcacccatacagaacgtgggcctatcatggcagctacgaaaacaaacagactggatcagcatcatccatggtgaacggagtggttaggttgctaacaaaaccttgggacgttatccctatggtgacacagatggcaatgacagatacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagaaaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaacgaagatcactggttttccagagagaactccctgagtggagtggaaggagaagggctgcacaaactaggctacattttaagagacgtgagtaagaaagaaggaggagcaatgtacgctgatgacaccgcaggatgggacacaagaatcacattagaggacttaaaaaacgaagaaatggtgacaaaccacatggaaggagaacacaagaaacttgctgaagccatcttcaaattaacgtaccaaaacaaggtggtgcgtgtgcaaagaccaacgccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcaattgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcagcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaattccatatttggggaaaagagaagaccaatggtgcggctcattaattgggctaacaagcagggccacctgggcaaagaacatccaaacagcaataaaccaagttagatccctaataggcaatgaggaatacacagactacatgccatccatgaaaagatttagaagggaagaggaagaggcaggagtcttgtggtag

SEQ ID NO: 7057 - RNA, 9876 nt, synthetic construct
  misc_feature 1..9876: note = derived and/or modified CDS sequence (wt) from DENV-2__KC762668__SS-prME
  source 1..9876: mol_type = other RNA
actgcaggtataatcattatggtgattccaacagtgatggcgttccatttaaccacacgcaacggagaaccacacatgatcgtcagtagacaagagaaagggaaaagtcttctgtttaaaacagagaacggtgtgaacatgtgcaccctcatggccatggaccttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacaaagaattgaaacttgggtcttgagacatccaggcttcaccataatggcagcaatcctggcatacaccataggaacgacatacttccaaagagtcctgattttcatcttactgacagctgtcgctccttcaatgacaatgcgttgcataggaatatcaaatagagactttgtggaaggggtttcaggaggaagctgggttgacatagttttggaacatggaagctgtgtgacgacgatggcgaaaaataaaccaacattggattttgaactgataaagacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggagggaaaaatcgtgcagccagaaaacctggagtacaccattgtgataacacctcactcaggggaagagaatgcagtcggaaatgacacaggaaaacacggcaaggaaattaaaataacaccacagagttccatcacagaagcagaactaacaggctatggcactgttacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccacgcaaagaaacaggatgttgttgttttaggatcccaagaaggggctatgcacacagcactcacaggggccacggaaatccagatgtcatcaggaaacttactgttcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggccgcttgattacagtcaacccaattgtcacagaaaaagacagcccagtcaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggaccatgaaaatcctcataggagttgtcatcacatggataggaatgaattcacgcagcacctcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcacacatggacagaacaatacaaatttcaaccagaatccccttcaaagctggcttcagctatccagaaggctcatgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagactatggctttggagtattcaccaccaacatatggctgaaattgaaagaaaggcaggatgtattttgtgactcaaaactcatgtcagcagccataaaagacaacagagccgtccacgccgacatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactaccgcttctggaaaactcataacagaatggtgctgccgatcttgcacattaccaccgctaaggtacagaggtgaggatggatgctggtatggaatggaaatcagaccattgaaggagaaagaagagaatttggtcaactctttggttacagccggacatggacagattgacaacttctcactaggagtcttgggaatggcattgttcctggaagagatgctcagaacccgagtaggaacgaaacatgcaatattactagttgcagtctctttcgtgacattgatcacagggaacatgtcctttcgagatttggggagagtgatggtcatggtaggcgctactatgacggatgacataggcatgggcgtgacttatcttgccctattagcagccttcaaggtcagaccaacttttgcagctggactactcttaagaaagctgacctccaaagaattgatgatgaccaccataggaatcgtactcctctctcagagcaccataccagagactatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagtaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactagagagagctgctgacgtaagatgggaagaacaggcagagatatcaggaagcagtccaattctgtcgataacaatatcggaagatggtagcatgtcgataaaaaatgaagaagaagaacaaacactgaccatactgattagaacaggactgctggtgatatcaggactttttcccgtgtcaataccaatcacggcagctgcatggtacctgtgggaagtgaaaaaacaacgagccggagtgttgtgggatgtcccttcgcctccacctgtgggaaaggccgaactggaagatggagcctatagaatcaagcagaaagggattctaggatactcgcagatcggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcttggcattagagcctggaaagaatccaagagccgtccaaacaaaacccggtctttttaaaactaacactggaatcataggcgccgtgtctctggacttttctcctggaacgtcaggatctccaattgtcgacaaaaaaggaaaagttgtgggcctttatggcaacggtgtcgtcacaaggagtggaacatatgtgagtgccatagcccagactgaaaaaagcattgaagacaacccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaattcctgaacgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattttgaatatatcaagactaggaccaatgattgggactttgtggtcacgacagacatttcagaaatgggtgctaacttcaaggctgagagggttatagaccccagacgctgcatgaaaccagtcatactaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgatgaagactgcgcacactggaaagaagctaagatgcttctagataacatcaacacgcctgaaggaatcattcccagcatgttcgaaccagagcgtgaaaaggtcgacgccattgatggtgaataccgcttgagaggagaagcgaggaaaacatttgtggacctaatgagaagaggagacctaccagtctggctagcctatagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttagatgctaggatctactctgacccactggcactcaaagaattcaaggaattcgcagctggaagaaaatccctgaccttgaatctaatcaccgagatgggtaggctcccaaccttcatgacccagaaagcaaggaatgcactggacaacttagcagtcctgcatacagctgaagcaggcggaagggcatacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggccagtattctcctatggtatgcacaaatacagccacattggatagcagcttcaataatactggagttttttctaatagtcttgctcattccagaaccagaaaagcagagaacaccccaagacaaccaattaacttatgtcgtcatagccatccttacagtggtggccgcaaccatggcaaacgagatgggtttcctggaaaaaacaaagaaagatttcggattgggaagcattacaacccagcaacttgagagcaacatcctggacatagatctacgtcctgcatcagcttggactctatatgccgtggcaacaactttcatcacaccaatgttgagacatagcattgaaaattcctcagtgaatgtgtctctaacagccattgccaatcaagccacagtgttaatgggtcttgggaaaggatggccattgtcgaaaatggacatcggagttccccttctcgctatcggatgctactcacaagtcaaccccataactctcacagcagcccttctcttattggtagcacattacgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctctatgtgaggccctaaccttagcgaccgggcccatctctacactgtgggaaggaaatccagggagattttggaatacaactattgcagtgtcaatggctaacatttttagagggagttacctggccggagctggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaagagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaatagattcacaatgagacacaagaaggccacatacgagccagatgttgatctcggaagtggaacccgcaacatcggaattgaaagtgagacaccaaatctagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtaacacagatggcaatgacagacacgactccatttggacaacagcgcgttttcaaagagaaagtggacacgagaacccaagaaccgaaagagggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttgaaaaatgaagaaatggtgacaaaccacatggaaggagaacacaagagacttgccgaagccattttcagattaacgtaccaaaacaaagtggtgcgtgtgcaaagaccgacaccaagaggcacagtaatggacatcatatcgagaagagaccaaagaggtagtggacaagttgtcacctacggcctcaatactttcaccaacatggaagcccaactgatcagacagatggagggagaaggagtcttcaaaagcatccagcacctgacagtcacagaagaaattgcagtgaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtacttgtagttccatgtagaaaccaagatgaactgattggtagggcccgaatttcccagggagccgggtggtccttgcgggaaacagcctgtttggggaagtcttacgcccaaatgtggagcctgatgtacttccacagacgtgaccttaggttggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggctacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7058 - RNA, 9876 nt, synthetic construct
  misc_feature 1..9876: note = derived and/or modified CDS sequence (wt) from DENV-2__KC762678__SS-prME
  source 1..9876: mol_type = other RNA
actgcaggcataattatcatgatgatcccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaacggaaacatggatgtcatcagaaggggcctggaaacatgcccagagaatcgaaacttgggtcttgagacatccaggcttcaccataatggcagcaatcctggcatataccataggaacaacatatttccaaagaatcctgattttcattttactgacagctgtcactccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcctgctactctaaggaagtattgtatagaggcaaagctgaccaacacaacaacagcatctcgctgcccaacacaaggagaacctagcctaaacgaagaacaggacaaaaggttcgtctgcaaacactccatggtagacagaggatggggaaatggatgcggattatttggaaaaggaggcatcgtgacctgtgcaatgttcacatgcaaaaagaacatggaaggaaaaatcgtgcaaccagaaaacttagagtacaccattgtgataacacctcactcaggggaagagaatgcagtcggaaatgacacaggaaaacacggcaaggaaattaaagtaacaccacagagttccatcacagaagcagagctaacaggctatggcactgtcacgatggaatgctctccgagaacgggcctcgacttcaatgagatggtgttgctgcaaatggaaaataaggcttggctggtgcacaggcaatggttcttagacctgccgttaccatggctgcccggagcagacacacaaggatcaaattggatacagaaggagacattggtcactttcaaaaatccccatgcaaagaaacaggatgttgttgttttaggatcccaagaaggggctatgcatacagcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggacttggaaaaaagacatgttttaggtcgcttgattacagtcaacccaattgtcacagaaaaagatagcccagtcaacatagaagcagaacctccattcggagacagctacatcattataggagtggaaccgggacaactgaagctcagctggtttaagaaaggaagttctattggccaaatgtttgagacaacaatgagaggagcgaaaagaatggccattttaggtgacacagcttgggattttggatccctgggaggagtgttcacatctataggaaaggccctccaccaagtcttcggagctatctatggggctgccttcagtggggtttcatggaccatgaaaatcctcataggagtcgtcatcacatggataggaatgaattcacgcagcacctcactgtctgtgtcactagtattagtgggggtcgtgacattgtatttgggagtcatggtgcaggccgatagcggttgcgttgtgagttggaaaaacaaagaactgaaatgtggcagtgggatttttatcacagacaacgtgcacacatggacagaacaatacaaattccaaccagaatccccttcaaagctggcttcagccatccagaaggctcatgaagaaggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcgtggaaaacatggggcaaagcgaaaatgctttccacagagcttcataaccacacctttctcattgatggccccgaaacagcagaatgtcccaacgcaaacagagcttggaattcactagaagttgaagactatggctttggagtattcaccaccaacatatggctgaaattgaaagaaaggcaggatgcattttgtgactcaaaactcatgtcagcagccataaaagacaacagagccgttcacgccgatatgggttattggatagaaagcgcactcaacgacacatggaagattgagaaagcttcttttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggattgtggaaatagaggaccctccttaagaacaactactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgatataggcataggcgtgacttatcttgccctattagcagcattcaaagtcagaccaacttttgcggctggactactcttaagaaagctgacctccaaggaattgatgatgaccaccataggaatcacactcctctctcagagtaccataccagagactatacttgaactgactgacgcgttggctttggggatgatggttctcaaaatagtgagaaacatggaaaagtaccaactagcagtgactatcatggccatcttgtgcgtcccaaatgcagtgatattacaaaacgcatggaaagtgagctgcacaacattggcagtggtgtccgtttccccactgcttttaacatcctcacagcagaaagcggattggataccactcgcgttgacgatcaaaggcctcaatccaacagccattttcttaacaaccctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtactcactggaagatcggctgatttggaactggaaagagctgctgacgtaagatgggaagaacaggcagagatatcaggaagtagtccaattctctcgataacaatatcggaagatggtagcatgtcgataaaaaatgaagaagaagaacaaacactgaccatactcattagaacaggactgctggtgatatcaggactttttcctgtgtcaataccaatcacagcagctgcatggtacctgtgggaagtgaaaaaacaacgggcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcataaagggaaaagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaaccagcactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgagggttgagaacgctaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagctacccctcctggaagcagagacccatttcctcagagcaatgcaccaatcatggatgaagaaagagaaatccctgagcgttcgtggaactctggacatgagtgggttacggactttaaagggaagactgtttggtttgttccaagtataaaagcagggaatgatatagcagcttgcctgagaaagaatggaaagaaggtgatacaacttagcaggaagacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcctggcaggacccatgccagtgacccactctagtgcagcacaaagaagagggagagtaggaagaaatccaaaaaatgaaaatgaccagtacatatacatgggggaacctctggaaaatgacgaagactgtgcacactggaaagaagctaagatgcttttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaataaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtagactcccaaccttcatgacccagaaagtaaggaatgcactggacaacttagcagtcctgcatacggctgaagcaggcggaagggcgtacaaccatgctcttagtgaactgccggagactctggaaacattgcttttactgacacttttagccacagtcacgggcggaatcttcctgttcttgatgagcggaaaaggtgtaggaaagatgaccctgggaatgtgctgcataatcacggctagtattctcctatggtatgcgcaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagtattgaaaattcctcagtgaatgtgtctctaacagccattgccaaccaagccacagtgttgatgggtcttgggaaaggatggccattatcaaaaatggacatcggagttccccttctcgccatcgggtgctattcacaagtcaaccccataactctcacagcagcccttctcttattggtagcacattatgctatcatagggccaggactccaagcgaaagcaaccagagaagcccagaaaagaacagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagccctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaatcggttgaatgcattgggaaagagtgaattccagatctataagaaaagtggaatccaggaagtagatagaaccttagcaaaagaaggcatcaaaagaggagaaacagaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacctattcccatgtcaacatatggttggaatctggtgcgtcttcaaagtggagttgatgttttttttactccgccagaaaagtgtgacactttgctgtgtgacataggggagtcgtcaccaaaccctacggtagaggcaggacgaacactcagagttctaaacttagtggaaaattggctgaataacaacacccaattttgcataaaggttctcagcccatacatgccctcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggcttctaacaaaaccttgggacgtcatccctatggtgacacaaatggcaatgacagacacgactccatttggacaacagcgcgtcttcaaagagaaagtggacacaagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagcggattttgggaattggttgacaaggaaaggaacctccatcttgaaggaaagtgtgagacatgtgtgtataacatgatgggaaagagagagaaaaaactaggggagttcggcaaagcaaaaggcagcagagccatatggtacatgtggcttggagcacgcttcttagagttcgaagctctaggattcctgaatgaagatcactggttttccagagagaactccctgagtggagtggaaggagaaggactgcacaaactaggttacattttaagagacgtgagtaagaaagaaggaggagcaatgtatgccgatgacaccgcaggatgggacacaagaatcacactagaggacttaaaaaatgaagaaatggtgacaaatcacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcactaacatggaagcccaactgatcagacagatggaaggagaaggagtcttcaaaagcatccagcaactgacagtcacagaagaaattgcagtgaaaaactggttagtgacagtggggcgtgagaggttatcaagaatggctatcagtggagatgattgtgttgtgaaacccttagatgacaggttcgcaagtgctctaacagctctaaatgacatgggaaaggttaggaaagacatacaacaatgggaaccttcaagaggatggaacgattggacacaagtgcccttttgttcacaccacttccatgagttaatcatgaaggacggtcgtgtactcgtagttccatgcagaaaccaagatgaactgattggtagggcccgaatttcccagggagccgggtggtccttgcgggaaacagcctgtttggggaagtcctacgcccaaatgtggagcctgatgtacttccacagacgtgaccttagactggcggcaaatgccatttgctcggcagttccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggctacctgggcaaagaacatccaaacagcaataaatcaagtcagatccctaataggcaatgaggaatacacagactacatgccatccatgaaaagattcagaagagaagaggaagaggcaggagtcttgtggtag

SEQ ID NO: 7059 - RNA, 9876 nt, synthetic construct
  misc_feature 1..9876: note = derived and/or modified CDS sequence (wt) from DENV-2__KC762679__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgctggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacgtgggtcttgagacatccaggcttcaccataatggcagcaatcctggcttacaccataggaacgacatatttccaaagagtcctgatcttcatcttactgacagctgttgctccttcaatgacaatgcgttgtataggaatatcaaatagagactttgtggaaggggtatcaggaggaagctgggttgacatagtcttggaacatggaagctgtgtgacgacgatggcaaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacctggagtacaccattgtgataacacctcactcaggggaagagaatgcagtcggaaatgacacaggaaaacacggtaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccctttgaaataatggatttggaaaaaagatatgtcttaggtcgcttgattacagtcaacccaattgtcacagaaaaagacagtccagtcaacatagaagcagaacctccattcggggacagctatatcattataggagtagaaccaggacaattgaagctcaactggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactagagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacaccttcctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcggcagccataaaagacagcagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaactttgcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccttctttaagaacaactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtgctcctctcccaggccaccataccagagactatacttgaactgactgacgcgttggctttggggatgatggttctcaaaatagtgagaaacatggaaaagtatcaactagcagtgactatcatggccattttgtgcgtcccaaatgcagtgatattacaaaatgcatggaaagtgagctgcacgacactggcagtggtgtccgtttccccactgcttttaacatcctcacagcagaaagcggattggataccactggcgctgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctacagaatcaagcagaaagggattctaggatactcgcagatcggagctggagtttacaaagaaggaacttttcacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaggtcctggcattagagcctggaaagaatccaagagccgtccaaacaaaacccggtctttttaaaactaatactggaaccataggtgccgtgtctctggacttttctcctggaacgtcaggatctccaatcgtcgacaaaaaaggaaaagtggtgggcctttatggcaacggtgtcgttacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagtggtggcggctgaaatggaagaagctctcagaggacttccaataagataccaaaccccagctattagagctgagcacactgggcgggagattgtggatctaatgtgtcacgccacatttaccatgaggctgctatcaccaattagagtgccaaattataacctgattatcatggatgaagcccattttacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggtcacggatttcaaagggaagactgtttggtttgttccaagcataaaagcagggaatgacatagcagcttgcctgagaaagaatggaaagaaagtgatacaactcagcaggaagacttttgactctgaatatataaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacattaacacgcctgaaggaatcattcccagcatgttcgaaccagagcgtgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggagttcgcagctggaagaaagtccctgacactgaatctaatcacagagatgggtaggctcccaaccttcatgacccagaaagcaaggaatgcactggataacttagcagtcttgcatacagccgaagcaggcggaagggcgtacaatcatgctcttagtgaactgccggagactctggagacattgcttttactgacactcttggccacagtcacgggcggaatcttcctgttcttgatgagcggaaaaggtatagggaagatgaccttgggaatgtgctgcataatcacggccagcattctcctatggtatgctcaaatacagccacactggatagcagcttcaataatattggagttttttctcatagtcttgctcattccagaaccagaaaagcagagaacgccccaagataaccaattaacttatgttgtcatagccatcctcacagtggtggccgcaaccatggcaaacgagatgggttttctggaaaaaacaaagaaagatttcggactgggaagcattacaacccagcaacctgagagcaacatcctggacatagatctacgtcctgcatcagcttggactctatatgccgtggcaacaaccttcatcacaccaatgttgagacatagtattgaaaattcctcagtgaatgtgtctctaacagccattgccaaccaagccacagtgttaatgggtcttgggaaaggatggccattgtcaaagatggatatcggagttccccttctcgctatcgggtgctattcacaagtcaaccccataactctcacagcagcccttctcctattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactttgggaaggaaatccaggaagattctggaatacaactattgcagtgtcaatggctaacatttttagagggagttacctggccggagccggacttctcttttctatcatgaagaacacggccaacacaagaaggggaactggcaacacgggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcatgctgtgtcgcgaggctcggcgaaactgagatggttcgtcgagagaaacctggttacaccagaagggaaagtagtggaccttggttgtggcaggggaggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccaccagaaaagtgtgacacattgctgtgtgacataggggagtcgtcaccaaaccccactgttgaagcaggacgaacactcagagttctaaacctagtggaaaattggctgaacaataacacccaattttgcataaaggttctcaatccatatatgccctcagtcatagaaaaaatggaagcgctacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcttaccatggcagctacgaaacaaaacagactggatcagcatcatccatggtgaacggagtggttaggctgctaacaaaaccttgggacgttatccctatggtgacacagatggcaatgacagacacgactccatttggacaacagcgcgttttcaaagagaaagtggacacgagaacccaagaaccgaaagaaggcacgaaaaaactaatgaagatcacggcagaatggctctggaaagaactaggaaagaaaaagacacctaggatgtgcaccagagaagaattcacaagaaaggtgagaagtaatgcagccttaggcgccatattcactgatgagaataagtggaagtcggcacgtgaggctgttgaagacagcggattttgggaactggttgacaaagaaaggaatctccatcttgaaggaaagtgtgagacatgcgtatataacatgatgggaaagagagagaagaaactaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtatgaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaactaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccattagtggagatgattgtgttgtgaaacccttagatgacaggtttgcaagcgctctaacagctctaaatgacatgggaaaggttaggaaagacatacaacaatgggaaccttcaagaggatggaacgactggacacaagtgcctttttgttcacatcatttccatgagttaatcatgaaggacggtcgtgtactcgtagttccatgcagaaatcaagatgaactgattggtagggcccgaatatcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctaacagtttggaacagggtgtggattcaagaaaacccatggatggaagacaaaactccagtggaatcatgggaggaaatcccatatttggggaaaagagaagaccaatggtgcggctcattgattgggctaacaagcagggccacctgggcaaagaatatccaaacagcaataaatcaagttagatccctaataggcaatgaggaatacacagactacatgccatccatgaaaagatttagaagagaagaggaagaggcaggagtcttgtggtag

SEQ ID NO: 7060 - RNA, 9876 nt, synthetic construct
  misc_feature 1..9876: note = derived and/or modified CDS sequence (wt) from DENV-2__KC762680__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgctggtgcaactctacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacgtgggtcttgagacatccaggcttcaccataatggcagcaatcctggcttacaccataggaacgacatatttccaaagagtcctgatcttcatcttactgacagctgttgctccttcaatgacaatgcgttgtataggaatatcaaatagagactttgtggaaggggtatcaggaggaagctgggttgacatagtcttggaacatggaagctgtgtgacgacgatggcaaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggtatcgtgacctgtgcaatgttcacatgcaaaaagaacatggaaggaaaaatcgtgcaaccagaaaacctggagtacaccattgtgataacacctcactcaggggaagagaatgcagtcggaaatgacacaggaaaacacggtaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggccatgcacacagcactcacaggggccacggaaatccagatgtcatcaggaaacttgctgttcacaggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccctttgaaataatggatttggaaaaaagatatgtcttaggtcgcttgattacagtcaacccaattgtcacagaaaaagacagtccagtcaacatagaagcagaacctccattcggggacagctatatcattataggagtagaaccaggacaattgaagctcaactggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactagagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacaccttcctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcggcagccataaaagacagcagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaactttgcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccttctttaagaacaactactgcttctggaaaactcataacagagtggtgttgccgatcttgcacattaccaccgctaaggtacagaggtgaggatggatgctggtatggaatggaaattagaccattgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaatcgtgctcctctcccaggccaccataccagagactatacttgaactgactgacgcgttggctttggggatgatggttctcaaaatagtgagaaacatggaaaagtatcaactagcagtgactatcatggccattttgtgcgtcccaaatgcagtgatattacaaaatgcatggaaagtgagctgcacgacactggcagtggtgtccgtttccccactgcttttaacatcctcacagcagaaagcggattggataccactggcgctgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctacagaatcaagcagaaagggattctaggatactcgcagatcggagctggagtttacaaagaaggaacttttcacacaatgtggcatgtcacacgtggtgctgtcctaatgcataaagggaagagaattgaaccatcatgggcggacgtcaagaaagatctaatatcgtatggaggaggctggaagctagaaggagaatggaaggaaggagaagaagtccaggtcctggcattagagcctggaaagaatccaagagccgtccaaacaaaacccggtctttttaaaactaatactggaaccataggtgccgtgtctctggacttttctcctggaacgtcaggatctccaatcgtcgacaaaaaaggaaaagtggtgggcctttatggcaacggtgtcgttacaaggagtggaacatatgtgagtgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagtggtggcggctgaaatggaagaagctctcagaggacttccaataagataccaaaccccagctattagagctgagcacactgggcgggagattgtggatctaatgtgtcacgccacatttaccatgaggctgctatcaccaattagagtgccaaattataacctgattatcatggatgaagcccattttacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggtcacggatttcaaagggaagactgtttggtttgttccaagcataaaagcagggaatgacatagcagcttgcctgagaaagaatggaaagaaagtgatacaactcagcaggaagacttttgactttgaatatataaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacattaacacgcctgaaggaatcattcccagcatgttcgaaccagagcgtgaaaaggtggatgccattgatggtgaataccgcttgagaggagaagcgaggaaaactttcgtggacctaatgagaagaggagacctaccagtctggttagcctacagagtggcagctgaaggtatcaattacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggagttcgcagctggaagaaagtccctgacactgaatctaatcacagagatgggtaggctcccaaccttcatgacccagaaagcaaggaatgcactggataacttagcagtcttgcatacagccgaagcaggcggaagggcgtacaatcatgctcttagtgaactgccggagactctggagacattgcttttactgacactcttggccacagtcacgggcggaatcttcctgttcttgatgagcggaaaaggtatagggaagatgaccttgggaatgtgctgcataatcacggccagcattctcctatggtatgctcaaatacagccacactggatagcagcttcaataatattggagttttttctcatagtcttgctcattccagaaccagaaaagcagagaacgccccaagataaccaattaacttatgttgtcatagccatcctcacagtggtggccgcaaccatggcaaacgagatgggttttctggaaaaaacaaagaaagatttcggactgggaagcattacaacccagcaacctgagagcaacatcctggacatagatctacgtcctgcatcagcttggactctatatgccgtggcaacaaccttcatcacaccaatgttgagacatagtattgaaaattcctcagtgaatgtgtctctaacagccattgccaaccaagccacagtgttaatgggtcttgggaaaggatggccattgtcaaagatggatatcggagttccccttctcgctatcgggtgctattcacaagtcaaccccataactctcacagcagcccttctcctattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactttgggaaggaaatccaggaagattctggaatacaactattgcagtgtcaatggctaacatttttagagggagttacctggccggagccggacttctcttttctatcatgaagaacacggccaacacaagaaggggaactggcaacacgggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcatgctgtgtcgcgaggctcggcgaaactgagatggttcgtcgagagaaacctggttacaccagaagggaaagtagtggaccttggttgtggcaggggaggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccaccagaaaagtgtgacacattgctgtgtgacataggggagtcgtcaccaaaccccactgttgaagcaggacgaacactcagagttctaaacctagtggaaaattggctgaacaataacacccaattttgcataaaggttctcaatccatatatgccctcagtcatagaaaaaatggaagcgctacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcttaccatggcagctacgaaacaaaacagactggatcagcatcatccatggtgaacggagtggttaggctgctaacaaaaccttgggacgttatccctatggtgacacagatggcaatgacagacacgactccatttggacaacagcgcgttttcaaagagaaagtggacacgagaacccaagaaccgaaagaaggcacgaaaaaactaatgaagatcacggcagaatggctctggaaagaactaggaaagaaaaagacacctaggatgtgcaccagagaagaattcacaagaaaggtgagaagtaatgcagccttaggcgccatattcactgatgagaataagtggaagtcggcacgtgaggctgttgaagacagcggattttgggaactggttgacaaagaaaggaatctccatcttgaaggaaagtgtgagacatgcgtatataacatgatgggaaagagagagaagaaactaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtatgaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaactaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttatcaagaatggccattagtggagatgattgtgttgtgaaacccttagatgacaggtttgcaagcgctctaacagctctaaatgacatgggaaaggttaggaaagacatacaacaatgggaaccttcaagaggatggaacgactggacacaagtgcctttttgttcacatcatttccatgagttaatcatgaaggacggtcgtgtactcgtagttccatgcagaaatcaagatgaactgattggtagggcccgaatatcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctaacagtttggaacagggtgtggattcaagaaaacccatggatggaagacaaaactccagtggaatcatgggaggaaatcccatatttggggaaaagagaagaccaatggtgcggctcattgattgggctaacaagcagggccacctgggcaaagaatatccaaacagcaataaatcaagttagatccctaaaaggcaatgaggaatacacagactacatgccatccatgaaaagatttagaagagaagagggagaggcaggagtcttgtggtag

SEQ ID NO: 7061 - RNA, 9876 nt, synthetic construct
  misc_feature 1..9876: note = derived and/or modified CDS sequence (wt) from DENV-2__JQ955624__SS-prME
  source 1..9876: mol_type = other RNA
actgcaggcgtgatcatcatgctaattccaacagcgatggctttccatttaactacacgcaacggagaaccacacatgatcgtcagcagacaagagaaagggaaaagtctcttgttcaaaacagaggatggtgtgaacatgtgtaccctcatggccatggaccttggtgaactgtgtgaagacacaatcacttataactgtcctcttctcaggcagaatgaaccagaagatatagattgttggtgtaattccacgtccacatgggtaacttacgggacatgcactgccacaggagaacatagaagggaaaaaagatcagtggcactcgtcccacatgtgggaatgggattggagacacgaactgaaacatggatgtcatcagaaggggcctggaaacacgcccagagaattgaaacctggatcttgagacatccaggttttgccataatggcagcaatcttggcatacaccataggaacaacacatttccaaagagtcctgatcttcatcttactgacagctgtcgccccttcaatgacaatgcgttgtattggaatatcaaatagagactttgtggaaggggtttcaggaggaagttgggttgacatagtcttagaacatggaagctgtgtgacaacgatggcaaaaaataaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtttgcaaacattccatggtagacagaggatggggaaatggatgtggattatttggaaagggaggcatcgtgacctgtgctatgttcacatgcaaaaaaaacatggaaggaaaaattgtgcaaccagaaaatctggaatacaccattgtggtaacacctcattcaggggaagagaatgcagttggaaatgacacaggaaaacatggcaaggaaatcaaagtaacaccacagagttccattacagaagcagaactgacaggctacggcactgtcacgatggagtgctctccaagaacgggcctcgacttcaatgaaatggtgttgctgcaaatggaaaataaggcttggctggtgcacaggcaatggttcttagacctgccgttaccatggctgcccggagcggacacacaaggatcaaattggatacagaaggagacgttggtcaccttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagagacacaacatggaacaatagttgtcagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacctccatttggagacagctacatcattataggagtagaaccgggacaactgaagctcagctggtttaagaaaggaagctcaatcggccaaatgttcgagacaacaatgagaggagcgaagagaatggccatcttaggtgacacagcctgggattttggatccctgggaggagtgttcacatctataggaaaggccctccaccaagttttcggagcaatctatggggccgccttcagtggggtctcatggactatgaaaatcctcataggagttgtcatcacatggataggaatgaattcacgtagcacctcactgtctgtgtcactagtattagtgggagtcgtgacattgtacttgggagttatggtgcaggctgatagtggctgtgttgtgagttggaaaaacaaagaattgaaatgtggcagcgggatttttatcacagacaatgtacacacatggacagaacaatacaaattccaaccagaatccccctcaaagctggcttcagctatccagaaagctcatgaagagggcatttgtggaatccgctcagtaacaagactggagaatctaatgtggaaacaaataacaccagaactgaatcacattctatcagaaaatgaggtaaagttgactatcatgacaggagacatcaaaggtatcatgcaggcaggaaaacgatccctgcggcctcagcccactgagctgaagtattcatggaaaacgtggggcaaagcgaaaatgctctccacagagtcccataaccagacctttctcattgatggccccgaaacaacagaatgtcccaacacaaacagagcttggaactcactagaagttgaagactatggctttggggtattcaccaccaacatatggctgaagttgaaagaaaggcaagatgtgttttgtgactcaaaactcatgtcagcggccgtaaaagacaacagagccgtccatgccgatatgggttattggatagaaagcgcactcaatgacacatggaagatagaaaaagcttcttttattgaagtcaaaagttgccactggccaaaatcacacactctctggagcaatggagtgctagaaagtgagatgataattccaaagaattttgctggaccagtatcacaacataattacagaccaggctatcacacacaaacggcaggaccttggcacctaggcaagcttgagatggactttgatttttgcgaaggaactacagtggtggtgactgaagactgtggaaatagaggaccctctttaagaacaactaccgcttctggaaagctcataacagaatggtgctgccgatcctgcacattaccaccactaagatacagaggtgaggatggatgctggtacggaatggaaattagaccattgaaagagaaagaagagaacttggtcaattccttggtcacagccggacatggacagattgacaacttctcactaggaatcttgggaatggcactgttcctggaagaaatgctcaggacccgagtaggaacaaaacacgcagtattactagttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaattgtactcctctcccagagcaccataccagagaccatacttgaactgactgatgcgttggccttgggcatgatggttctcaagatagtgaggaatatggaaaagtatcagttagcagtgactatcatggctatcttatgtgttccaaacgcagtaatattacaaaatgcatggaaagtgagctgcacaatactggcagtggtgtccgtatccccactgctcttaacatcttcacagcagaaagcggattggataccattggcattgacgatcaaaggtctcaatccaacagccattttcctaacaaccctttcaagaaccaacaagaaaaggagttggccactaaatgaggctatcatggcagtagggatggtgagcattttagccagttctctcttgaagaatgacattcccatgacaggaccattagtggctggagggcttctcactgtgtgttacgtgctcactggaagatcggccgacttggaactggagagagccgccgatgtaagatgggaagatcaggcagagatatcaggaagcagtccaattctgtcaataacaatatcggaagatggcagtatgtcgataaaaaatgaagaggaagaacaaacactgaccatactcattagaacaggattgctggtgatatcaggactttttcccgtatcaataccaatcacagcagcagcatggtatctgtgggaagtgaagaaacaacgggctggagtattgtgggatgttccttcacccccacctgtgggaaaggccgaattggaagatggagcttatagaatcaagcagaaagggattcttggatactcccagatcggagctggagtttacaaagaaggaacattccacacaatgtggcacgtcacacgtggtgctgttctaatgcataaagggaagaggattgaaccatcatgggcggatgtcaggaaagacctaatatcgtatggaggaggctggaagctggaaggagaatggaaggaaggagaagaagtccaggtcttggcattagagcctggaaagaatccaagagccgtccaaacaaaacccggtctttttaaaactaacaccggaaccataggtgctgtgtctctagacttttctcctggaacgtcaggatctccaattgtcgacaaaaaaggaaaggtcgtgggtctctatggcaacggtgtcgtcacaagaagtggaacatatgtgagtgccatagcccaatctgaaaaaagcattgaagacaatccagagattgaagatgatatctttcggaaaaaaagattaaccattatggacctccacccaggagcgggaaagacgaaaagataccttccagcaatagttagagaggccataaaacgaggcttaagaacattaatcctggcccccactagagtcgtggcagctgaaatggaagaagctcttagaggacttccaataagataccaaaccccagccattagagctgagcacacagggcgagaaatcgtggatttaatgtgtcatgccacatttaccatgaggctgttatcaccagttagagtgccaaattacaacttgatcatcatggatgaagcccatttcacagacccagcaagcatagcagccagaggatatatttcaactcgagtggagatgggtgaagcagctgggatttttatgacagccactcctccaggaagcagagacccatttcctcaaagcaatgcaccaatcatggatgaagaaagggaaatccctgaacgctcgtggaactctggacatgagtgggtcacagattttaaagggaagactgtttggtttgttccgagtataaaagcgggaaatgatatagcagcttgcctgagaaaaaatggaaagaaagtgatacaactcagtaggaagacctttgattctgaatacatcaagactagaaccaatgattgggattttgtggtcacgactgacatttcagaaatgggtgccaacttcaaggctgaaagggttatagaccccaggcgctgcatgaaaccagtcatactgacagacggtgaagagcgggtgatcctggcaggacccatgccagtgactcactctagtgcagcacaaagaagagggagaataggaagaaatccaaaaaatgaaaatgaccagtacatatacatgggggaacctctggaaaatgatgaagactgtgcacactggaaagaagccaagatgcttttagacaacatcaacacgcctgaaggaatcattcccagcatgttcgaaccagagcgtgaaaaagtggatgccattgatggtgaatatcgcttaagaggagaagcgaggaaaacctttgtggagctaatgagaagaggagacctaccagtctggctggcctacagagtggcagccgaaggcattaactatgcagacagaaggtggtgttttgatggaatcaagaacaaccaaatcttggaagaaaatgtggaagtggaaatctggacaaaagaaggggaaaggaagaaactgaaacccagatggttggatgctaggatctactctgacccactggcgctcaaagaattcaaagagtttgcagctggaagaaaatccctgaccctgaatttaatcacagaaatgggtaggctcccaacttttatgactcagaaagcaaggaacgcactggataacttagcagtcctgcatacggccgaagcaggcggaagggcgtacaatcatgctctcagtgaactgccagagaccctggagacactgcttttgctgacacttttggccacagtcacgggtggaatctttttattcttgatgagtggaaaaggtatagggaaaatgaccctgggaatgtgctgcataatcacggccagcattctcctatggtacgcacaaatacagccacactggatagcagcttcaataatactggagttttttctcatagtcttgctcattccagagccagaaaagcaaagaacaccccaagacaaccaattgacttacgttgtcatagccatcctcacagtggtggctgcaaccatggcaaatgagatggggttcctggaaaaaacgaagaaagatttcggatttggaagcattgcaacccaacaacccgagagcaacatcctggacatagatctacgtcctgcatcagcatggaccctgtatgcagtggccacaacatttatcacaccaatgttgagacatagcattgaaaattcttcagtgaatgtgtctctaacagccattgccaatcaagccacagtgctaatgggtcttgggaaggggtggccattgtcaaaaatggacattggagttccccttctcgccatcgggtgctactcacaagtcaaccccataactctcacagcagcccttcttttattggtagcacactatgctatcatagggccaggactccaagcaaaagcaaccagagaagcgcagaaaagagcagcagcaggcatcatgaaaaacccaactgtggatggaataacagtgattgacctagatccaataccctatgatccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattttggaacacaaccattgcagtgtcaatggctaacatttttagaggaagttacctagctggagctggacttctcttttccatcatgaagaacacaaccaacacaagaaggggaactggcaacacaggagagacgcttggggagaaatggaaaaaccgattgaattcattggggaagagtgaattccagatctacaagagaagcggaatccaggaagtggatagaaccttagcaaaggaaggcattaaaagaggagaaacggaccatcacgctgtgtcgcgaggctcagcaaagctgagatggttcgtcgagagaaacctggttacaccagaggggaaagtaatggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactccgccagaaaaatgtgacacattgttgtgtgacataggggagtcgtcaccaaatcccacggttgaagcaggacgaacacttagagtcctaaacttggtagaaaattggctgaacaacaacacccaattttgcataaaggttctaaacccatacatgccctcagtcatcgaaaaaatggaaacgctgcaaaggaaatacggaggagctttggtgaggaatccactctcaaggaattccacacatgagatgtattgggtatctaatgcttccgggaacatagtgtcatcagtgaacatgatttcaaggatgttgatcaatagattcacaatgagacataagaaggccacatacgagccagatgttgacctcggaagcggaacccgcaacatcggaattgaaagtgagacaccaaacttagacataattgggaaaagaatagaaaaaataaaacaagagcatgagacatcatggcactatgaccaagaccacccatataaaacgtgggcctaccatggcagctacgaaacaaaacagactggatcggcatcatccatggtgaatggagtagttagactgctgacaaaaccttgggacgtcatccccatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaggaaagaaaaaaacacctagaatgtgcactagagaagaattcacaagaaaggtgagaagcaatgcagccctaggtgccatattcactgatgagaataagtggaagtcggcacgtgaggctgttgaagacagtagattttgggaactggttgacaaggaaaggaatctccatcttgaaggaaaatgtgagacatgtgtgtacaacatgatgggaaagagagagaagaagatgggagaattcggcaaagcaaaaggcagcagagccatatggtacatgtggcttggagcacgcttcttagagtttgaagccctgggattcttgaatgaagatcactggttttccagagagaactctctgagcggagtagaaggagaagggctgcacaagctgggttacattctaagagaagtgagcaagaaagaaggaggagcaatgtacgccgacgacacagcaggatgggacacaagaatcacactagaagacttaaaaaatgaagaaatggtgacaaaccacatggaaggagaacacaagaaacttgctgaggccattttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactgatcagacagatggagggagaaggagtctttaaaagcatccagcatctgacaaccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaatcaagatgaactgattggtagagctcgaatttcccagggagccgggtggtctttgcgggagacggcctgtctggggaagtcttacgcccaaatgtggagcctgatgtacttccacagacgtgatctcaggctggcggctaacgctatttgctcggcagtcccatcacattgggttccaacaagtcgaacaacctggtccatacacgccagacatgaatggatgacaacagaagacatgttgacagtctggaacagggtgtggattcaagaaaacccatggatggaagacaaaactccagtggaatcatgggaggaaatcccatacttggggaaaagagaagaccaatggtgcggctcattgatagggttaacaagcagggccacctgggcaaagaacatccaaacagcaataaaccaagtcagatccttaataggcagtgaggaatacacagactatatgccatccatgaaaagattcagaagagaagaggaagaggcaggggtcttgtggtag

SEQ ID NO: 7062 - RNA, 9876 nt, synthetic construct
  misc_feature 1..9876: note = derived and/or modified CDS sequence (wt) from DENV-2__KJ918750__SS-prME
  source 1..9876: mol_type = other RNA
actgcaggcatgatcatcatgctgattccaacagtgatggcgtttcatttgaccacacgcaacggagaaccacacatgattgtcagtagacaagaaaaggggaaaagccttctgtttaagacaaaggatggcacgaacatgtgcaccctcatggccatggaccttggtgagttgtgtgaagacacaatcacgtataaatgtccttttctcaggcagaacgaaccagaagacatagattgttggtgcaactccacgtccacatgggtaacttatgggacgtgtaccaccacaggagagcacagaagagaaaaaagatcagtggcgcttgttccacacgtgggaatgggattggagacacgaactgaaacatggatgtcatcagaaggggcctggaaacatgcccagagaattgaaatttggattctgagacatccaggctttaccataatggccgcaatcctggcatacaccataggaacgacgcatttccaaagagtcctgatattcatcttactgacagccatcgctccctcaatgacaatgcgctgcataggaatatcaaatagggactttgtggaaggagtgtcaggagggagttgggttgacatagtcttagaacatggaagttgtgtgacgacgatggcaaaaaataaaccaacattggactttgaactgataaaaacagaagccaaacaacccgccactctaaggaagtactgtatagaggctaaactgaccaacacgacaacagactcgcgctgcccaacacaaggggaacccaccctgaacgaagagcaggacaaaaggtttgtctgcaaacactccatggtagacagaggatggggaaatggatgtggattatttggaaaaggaggcatcgtgacctgtgctatgttcacatgcaaaaagatcatgaaaggaaaaattgtgcagccagaaaacttggaatacactgtcgtgataacacctcactcaggggaagaacatgcagtcggaaatgacacaggaaaacatggtaaggaagtcaagataacaccacagagctctatcacagaggcggaactgacaggctatggcactgttacgatggagtgctctccgagaacgggcctcgacttcaatgagatggtgttgctccaaatggaagacaaagcttggctggtgcacagacaatggttcctagacctaccgctgccatggctgcccggagcagacacacaaggatcaaattggatacagaaagagacattggtcactttcaaaaatccccatgcgaaaaaacaggacgttgttgtcttaggatcccaagagggggccatgcatacagcactcacaggggctacggaaatccagatgtcatcaggaaacttgctgttcacaggacatctcaaatgcaggctgagaatggacaaattacagcttaaagggatgtcatactccatgtgcacaggaaagtttaaagtcgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaagacagtccagtcaacatagaagcagaacctccattcggagacagctacatcatcataggagtggaaccaggacaattgaagcttaactggttcaagaaaggaagttccattggccaaatgttagagacaacaatgaggggagcgaaaagaatggccattttgggtgacacagcctgggattttggatctctgggaggagtgttcacatcaataggaaaggctctccaccaggtttttggagcaatctatggggctgctttcagtggggtctcatggactatgaagatcctcacaggagttatcatcacatggataggaatgaactcacgtagcacatcactgtctgtgtcactagtattagtgggaatcgtgacactatacttgggagttatggtgcaggccgatagtggttgcgttgtgagctggaagaacaaagaactaaaatgtggcagtggaatatttgtcacagataacgtgcatacatggacagaacaatacaagttccaaccagaatccccttcaaaactggcttcagccattcagaaagctcatgaagagggtatttgtggaatccgctcagtaacaagactggaaaatctcatgtggaaacagataacaccagaattgaatcacattctatcagaaaatgaagtgaagctgaccatcatgacaggagacatcaaaggaatcatgcaggtaggaaaacgatctctgcggcctcaacccactgagttgaggtattcatggaaaacatggggtaaagcgaaaatgctctccacagaactccacaatcagacctttctcattgatggtcccgaaacagcagaatgccccaacacaaacagagcttggaattcactggaagttgaggactacggctttggagtattcaccaccaatatatggctaagattgagagaaaagcaggatgtattttgtgactcaaaactcatgtcagcggccataaaggacaacagagccgtccatgctgatatgggttattggatagaaagcgcactcaatgacacatggaagatagagaaagcttctttcattgaagttaaaagttgccactggccaaagtcacacactctatggagcgatggagtactagaaagcgagatggtaattccaaagaatttcgctggaccagtgtcacaacataacaacagaccaggctatcacacacaaacagcaggaccttggcatctaggcaaacttgagatggactttgatttctgcgaagggactacagtggtggtaaccgaggactgtggaaacagagggccctctttaagaacaaccactgcctctggaaaactcataacggaatggtgctgtcgatcttgcacgttaccaccgctaagatacagaggtgaggatggatgctggtatgggatggaaatcagaccattaaaagagaaagaagaaaatctggtcagttctctggtcacagccggacatgggcagattgataatttctcattaggaatcttgggaatggcattgttccttgaagaaatgctcaggactcgagtaggaacgaaacatgcaatattactagtcgcagtttctttcgtgacattaatcacagggaacatgtcttttagagacctgggaagagtgatggttatggtgggtgccaccatgacagatgacataggtatgggtgtgacttatctcgctctactagcagctttcaaagtcagaccaacctttgcagctggactgctcttgagaaaactgacctccaaggaattaatgatgaccaccataggaatcgttcttctctcccaaagtagcataccagagaccattcttgaactgactgatgcgttagctttgggcatgatggtcctcaagatggtgagaaacatggaaaaatatcagctggcagtgaccatcatggccattttatgcgtcccaaatgctgtgatattacagaacgcatggaaagtgagttgcacaatattggcattggtgtctgtttcccccctgttcttaacatcctcacaacagaaagcggattggataccattagcattgacgatcaaaggtctcaatccaacagccatttttctaacaaccctctcaagaaccagcaagaaaaggagctggcctttaaatgaggccatcatggcggttgggatggtgagcatcttggccagctctctcttaaagaatgacatccccatgacaggaccattagtggctggaggtcttctaactgtgtgctatgtgctaactgggcggtcagccgatctagaattagagagagctgccgatgtcaaatgggatgaccaggcagagatatcagggagcagtccaattctgtcaataacaatatcagaagatggcagcatgtcaataaagaatgaagaagaagagcaaacactgactatactcattagaacaggattgcttgtgatctcaggactctttccggtatcaataccaattacagcagcagcatggtacctgtgggaagtgaagaaacaacgggctggagtgttgtgggatgtcccctcaccaccacccgtgggaaaggctgaattggaagatggagcctacagaatcaagcaaaaaggaattcttggatattcccagatcggagccggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcctggcattggagcctgggaaaaatccaagagccgtccaaacaaagcctggcctttttaaaaccaacaccggaaccataggtgccgtatctctggacttttcccctgggacgtcaggatctccaatcgtcgacaaaaaaggaaaagttgtaggtctctatggcaatggtgtcgttacaaggagtggagcatatgtgagtgccatagctcagactgaaaaaagcattgaagacaatccagagattgaagatgacatctttcgaaagagaagattgactatcatggatctccacccaggagcaggaaagacaaaaagatacctcccggccatagtcagggaggctataaaaagaggcttgagaacactaatcctagcccccactagagtcgtggcagccgaaatggaggaagcccttagaggacttccaataagataccaaaccccagctatcagggctgagcacaccgggcgggagattgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatctttatgacagccactcctccgggtagcagagatccatttcctcagagtaatgcaccaattatggacgaagaaagagaaattccggaacgttcgtggaactccggacatgagtgggtcacggattttaaaggaaagactgtttggtttgttccaagcataaaaaccggaaatgacatagcagcctgcctgagaaagaatggaaagagggtgatacaactcagtaggaagacctttgattctgaatatgtcaagactagaaccaatgactgggatttcgtggtcacaactgacatctcggaaatgggcgccaactttaaagctgagagggttatagaccccagacgctgcatgaaaccagttatactgacagacggcgaagagcgggtgattctggcaggacccatgccagtgacccactctagtgcagcacaaagaagagggagaataggaaggaatccaaagaatgaaaatgatcaatatatatatatgggggaacccttggaaaatgacgaagactgtgcgcactggaaggaagctaagatgctcctagataacatcaacacacctgaaggaatcattcctagcatgttcgagccagagcgtgaaaaggtggatgccattgacggtgaatatcgcttgagaggagaagcaaggaaaacttttgtggacctaatgagaagaggagacctaccagtctggttggcttataaagtggcagctgaaggtatcaactacgcagacagaagatggtgttttgacggaaccagaaacaatcaaatcttggaagaaaatgtggaagtggaaatctggacaaaggaaggggaaaggaaaaaattgaaacctagatggttggatgctaggatctactccgacccactggcgctaaaagaattcaaggaattcgcagccggaagaaagtccctaaccctgaacctaatcacagagatgggcagactcccaacttttatgactcagaaggccagagatgcactagacaacttagcggtgctgcatacggctgaagcaggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtgtgcacaaatacaaccacattggatagcagcttcaataatattggagttctttctcatagtcttgctcattccagaaccagaaaagcaaaggacaccccaggataaccaattgacctatgtcatcatagccatcctcacagtggtagccgcaaccatggcaaacgaaatgggtttcctggaaaaaacaaagaaagacctcggactgggaaacatagtaactcagcaacctgagagcaacattctggacatagatctacgtcctgcatcagcatggacgttgtatgccgtggctacaacatttatcacaccaatgttgagacatagcattgaaaattcctcagtaaacatgtccctaacagccattgctaaccaagccacagtactaatgggtctcgggaaaggatggccattgtcaaagatggacattggagttcccctccttgctattgggtgttgctcacaagtcaaccctataaccctcacagcggctctttttttattggtagcacattatgccatcataggaccgggacttcaagccaaagcaaccagagaagctcagaaaagagcagcagcgggcatcatgaaaaacccaactgtggatggaataacagtgatagatctagatccaataccctatgatccaaagtttgaaaaacagttgggacaagtaatgctcttagtcctctgtgtgacccaagtgctgatcatgaggactacgtgggctttgtgtgaagccttaactctagcaaccggacccgtatccacattgtgggaaggaaatccagggagattctggaacacaaccattgcagtgtcaatggcaaacatctttagagggagttacctggctggtgctggacttctcttttgtatcatgaataacacaaccaggttgagaagaggaactggccacttaagaaaaacgctaggcgacaaatgcaaaagcagactgaacaccttggggaaaagtgaattccagatctacaagaaaagtggaattcaagaagtggacagaaccttagcaaaagaaggcattaaaagaggagaaacggatcatcacgctgtgtcgcgaggctcagcaaaactgagatggttcgttgaaagaaatctggtcacaccagaagggaaagtagtggaccttggttgtggcagagggggctggtcatactattgtggaggactaaagaatgtaagagaagttaaaggcttgacaaagggaggaccaggacacgaagaacctatccccatgtcaacatatgggtggaatctagtacgcttacagagcggagttgacgttttcttcattccaccagagaagtgtgacacattgttgtgtgacataggggaatcatcaccaaatcccacggtagaagcgggacgaacactcagagtccttaacctagtagaaaattggctgaacaataacacccaattttgcataaaggtccttaacccgtacatgccctcagtcattgaaaaaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacttatgaaccagatgtcgacctcggaagcggaacccgcaatattggaattgaaagtgagacaccgaacctagacataattggaaaaagaatagaaaaaataaaacaagagcacgaaacgtcatggcactatgaccaagaccacccatacaaaacatgggcttaccatggcagctatgaaacaaaacagactggatcagcatcatccatggtgaacggagtagtcagactgctgacaaaaccctgggacgttgttccaatggtgacacagatggcaatgacagacacaactcctttcggacaacagcgcgtcttcaaggagaaggtggatacgagaacccaagaaccaaaagaaggcacaaaaaaattaatgaaaatcacggcagaatggctctggaaagaactaggaaagaaaaagacacctagaatgtgcaccagagaagaattcacaaaaaaggtgagaagtaatgcagccttgggggccatattcaccgatgagaacaagtggaaatcggcgcgtgaggctgttgaagatggcaggttttgggagctggttgacaaggaaaggaatctccatcttgaagggaaatgtgaaacatgtgtgtacaacatgatgggaaaaagagagaaaaaactaggagagtttggcaaagcaaaaggcagcagagccatatggtacatgtggcttggagcacgcttcttagagtttgaagccctaggatttttgaatgaagaccattggttctccagagagaactccctgagtggagtggaaggagaagggctgcacaagctaggttacatcttaagagaggtgagcaagaaagagggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaaccccaagaggcacagtaatggacatcatatcgagaagagaccaaaggggtagtggacaagttggtacctatggcctcaatactttcaccaacatggaagcacaactaattaggcaaatggagggggaaggaatcttcaaaagcatccagcacttgacagccacagaagaaatcgctgtgcaagattggctagcaagagtagggcgtgaaaggttatcaagaatggccatcagtggagatgattgtgttgtgaaacctctagatgatagatttgcaagagccctaacagctcttaatgacatgggaaaggttaggaaggacatacaacaatgggagccctcaagaggatggaacgactggacacaggtgcccttctgttcacaccattttcacgagttaattatgaaagatggtcgcacactcgtagttccatgtagaaaccaagatgaattgattggtagagcccgaatttcccagggagctgggtggtctttacgggagacggcctgtctggggaagtcttacgcccaaatgtggagcttgatgtactttcacagacgtgatctcaggctagcggcaaatgccatctgctcggcagtcccgtcacactgggttccaacaagccggacaacctggtccatacacgccagccatgaatggatgacgacggaagacatgttgacagtttggaacagagtgtggatccaagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaatcaagtcagatccctcattggcaatgaggaatacacagattacatgccatccatgaaaagattcagaagagaagaggaagaggcaggagttttgtggtag

SEQ ID NO: 7063 - RNA, 9876 nt, synthetic construct
  misc_feature 1..9876: note = derived and/or modified CDS sequence (wt) from DENV-2__KU517845__SS-prME
  source 1..9876: mol_type = other RNA
actgcaggtataattattatgatgatcccaacagtgatagcgttccatttaaccacacgcaacggagaaccacacatgatcgtcagtagacaagagaaagggaaaagccttctgtttaaaacagagaacggtgtgaacatgtgtaccctcatggccatggaccttggtgaactgtgtgaagacacaatcacttataactgtcctcttctcaggcagaatgaaccagaagacatagactgttggtgcaactctacgtctgcatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcatacaccataggaacaacatatttccaaagagtcctgattttcattttactgacagctgtcactccctcaatgacaatgcgttgtataggaatatcaaatagagactttgtggaaggggtttcaggagggagctgggttgacatagtcttggaacatggaagctgtgtgacgacgatggcgaaaaacaaaccaacattggattttgaactgataaaaacagaagccaaacatcctgctactctaaggaagtattgtatagaggcaaagctgaccaatacaacaacagcatctcgctgcccaacacaaggagaacctagcctaaatgaagaacaggacaaaagattcgtctgcaaacactccatggtagatagaggatggggaaatggatgcggattatttggaaagggaggtatcgtgacctgtgcaatgttcacatgtaaaaagaacatggaaggaaaaatcgtgcaaccagaaaatttggagtacaccatcgtgataacacctcactcaggggaagagaatgcagtcggaaatgacacaggaaaacacggcaaggaaattaaagtgacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaagagacattggtcactttcaaaaatccccatgcaaagaaacaggatgttgttgttttaggatcccaagaaggggctatgcacacagcactcacaggggccacggagatccagatgtcatcaggaaacttactgttcacaggacatcttaaatgcaggttgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccgattgtcacagaaaaagacagcccagtcaatatagaagcagaacctccattcggagatagctacatcattataggagtagaaccgggacaactgaagctcagctggttcaagaaaggaagttctattggccaaatgtttgagacaacaatgcgaggagcaaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgacagtggttgtgttgtgagttggaaaaacaaagaactgaaatgtggcagtgggatttttatcacagacaacgtgcacacatggacagaacaatacaaattccaaccagaatccccctcaaagctggcttcagctatccagaaggctcatgaagaaggcatttgtggaatccgctcagtaacaagactggagaatctgatgtggaaacaaataacaccagaattgaatcacattctatcagaaaatgaggtaaagttgactatcatggcaggagacattaaaggaatcatgcaagcaggaaaacgatccctgcggcctcaacccactgagctgaagtattcttggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccaccaacatatggttgaaattgaaggaaaggcaggatgcattttgtgactcaaaactcatgtcagcagccataaaagacaacagagccatccacgccgatatgggttattggatagaaagcgcactcaatgacacatggaagattgagaaagcctcctttattgaagttaaaagctgccactggccaaagtcacacactctctggagtaatggagtgctggaaagtgagatgataattccaaagaattttgcaggaccagtgtcacaacacaattacagaccaggctatcatacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggaatggaaatcagaccattgaaagagaaagaggagaacttggtcaattctttggtcacagccgggcatggacagattgacaacttctcactaggagtcttgggaatggcattgttcctggaagagatgctcaggacccgagtaggaacgaaacatgcaatattactagttgcagtttcttttgtgacattgatcacagggaacatgtcttttcgagatttgggaagagtgatggtcatggtgggcgctaccatgacggatgacataggcatgggcgtgacttatcttgccctattagcagccttcaaagtcagaccaacttttgcggctggactactcttaagaaagctgacctccaaggaattgatgatgaccaccataggaatcgtactcctctcacagagtaccataccagagactatacttgaactgactgatgcattggctctggggatgatggttctcaaaatagtgagaaatatggaaaagtatcaactagcagtgactatcatggccatcttgtgcgtcccaaatgcagtgatattacaaaacgcatggaaagtgagctgcacaacattggcagtggtgtccgtttccccactgcttttaacatcctcacagcagaaagcagattggataccactggtgttgacgatcaaaggcctcaatccaacagccattttcttaacaaccctctcaagaactagcaagaaaaggagctggccactaaatgaggctattatggcagtcgggatggtgagcattctagccagttctctcctaaagaatgatattcccatgacaggaccattagtggctggagggcttctcactgtgtgttacgtgctcactggaagatcggctgatttggaactggaaagagctgctgacgtaagatgggaagaacaggcagaaatttcaggaagtagtccaattctgtcgataacagtatcggaagatggtagcatgtcgataaaaaatgaagaagaagaacaaacattgaccatactcatcagaacaggactgctggtgatatcaggactttttcctgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggatcctaggatactcgcagattggagccggagtttacaaagaaggaacattccacacaatgtggcatgtcacacgtggtgctgtcctaatgcataaagggaagagaattgaaccatcatgggcggacgtcaaaaaagacctaatatcgtatggaggaggctggaagctagaaggagaatggaaggaaggagaagaagtccaggtcctggcattagagcctggaaagaacccaagagccgtccaaacaaaacccggtctttttaaaaccaacactggaaccataggcgccgtgtctctggatttctctcctggaacgtcaggatctccaatcgtcgacaaaaaaggaaaagttgtgggcctttatggcaacggtgttgtcacaaggagtggaacatatgtgagtgccatagcccagactgaaaaaagcatcgaagacaatccagagattgaagatgacatctttcgaaagaaaagattgaccatcatggacctccacccaggagcagggaaaacaaagagataccttccagcaatagtcagagaagccataaaacgaggcttgagaacactaatcctggcacccactagagttgtggcggctgaaatggaagaagctctcagaggacttccaataagataccaaaccccagctattagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctggtattttcatgacagctacccctcctggaagcagagacccatttcctcagagcaatgcaccaatcatggacgaagaaagagaaatccctgagcgttcgtggaactctggacatgagtgggttacggattttaaagggaagactgtttggtttgttccaagtataaaagcagggaatgacatagcagcttgcctgagaaagaatggaaagaaagtgatacaactcagcaggaagacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttttggacaacatcaacacgcctgaaggaatcattcctagcatgttcgaaccagagcgtgaaaaggtggatgccattgatggtgaataccgcttgagaggagaagcgaggaaaacttttgtggacctaatgagaagaggagatctaccagtctggctagcctacagagtggcagctgaaggtatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccactggcgctcaaagaattcaaggaattcgcagctggaagaaagtccctgaccctgaatctcatcacagagatgggtagactcccaaccttcatgacccagaaagcaaggaatgcattagacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaaaggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccagttaacttatgttgtcatagccatccttacagtggtggccgcaaccatggcaaacgagatgggtttcctggaaaaaacaaagaaagatttcggattgggaagcattgcaaaccagcaacctgagagtaatatcctggacatagatctacgtcctgcatcagcttggactctatatgccgtggcaacaactttcatcacaccaatgttgaggcatagcatagaaaattcctcagtgaatgtgtctttaacagccattgccaaccaagctacagtgttaatgggtcttgggaaaggatggccattatcaaaaatggacatcggagttccccttctcgctatcgggtgctattcacaagtcaaccccataactctcacagcagcccttctcttattggtagcacactatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctgttagtcctctgcgtgactcaagtgttgatgatgaggactacatgggctttatgtgaagctctaaccttagcaaccgggcccatctctacactgtgggaaggaaacccagggagattttggaatacaactattgcagtatcaatggctaacatttttagagggagttacctggccggagccggacttctcttttctatcatgaaaaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcattaaaagaggagaaacggaccatcacgctgtgtcgcgaggctcagcgaaactgagatggttcgtcgagagaaacttggtcacaccagaagggaaagtagtggaccttggctgcggcagggggggctggtcatactattgtgggggactaaagaatgtaaaagaagttaaaggcttaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcgttacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgaaccagatgttgacctcggaagtggaacccgcaacatcgggattgaaagtgagacaccaaatttagacataattgggaaaagaatagaaaaaataaaacaagagcatgaaacatcatggcactatgaccaagaccacccatacaaaacgtgggcctaccatggcagctacgaaacgaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaggaaggcacgaaaaaaataatgaaaatcacggcagaatggctttggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaacctccatcttgaaggaaagtgtgagacatgtgtgtacaacatgatgggaaagagagagaagaagctaggggagttcggcaaagcaaaaggcagcagggccatatggtacatgtggcttggagcacggttcttagagtttgaagctctaggattcttgaatgaagatcactggttttccagagagaactccctgagcggagtggaaggagaagggctgcacaaattaggctacattttaagagacgtgagtaagaaagaaggaggagcaatgtatgccgatgacaccgcaggatgggacacaagaatcacactagaggacttaaagaatgaagaaatggtgacaagccacatgaaaggagaacacaggaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacagatggagggagaaggagtcttcaaaagcatccagcaactgacagtcacagaagaaattgcagtgaaaaactggttagtaagagtggggcgtgagaggttgtcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgactggacacaagtgcccttttgttcacaccatttccatgagttaatcatgaaggacggtcgtgtactcgtagttccatgcagaaaccaagatgaactgattggtagggctcgaatttcccagggagccgggtggtccttgcgagaaacagcctgtttggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtttggaacagggtgtggattcaagaaaacccatggatggaagacaaaactccagtagaatcatgggaggaaatcccgtatttgggaaaaagagaagaccaatggtgcggctcattgattgggctaacaagcagggctacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 7064 - RNA, 9876 nt, synthetic construct
  misc_feature 1..9876: note = derived and/or modified CDS sequence (wt) from DENV-2__KU517847__SS-prME
  source 1..9876: mol_type = other RNA
actgcaggtataattattatgatgatcccaacagtgatggcgttccatttaaccacacgcaatggagaaccacacatgatcgtcagtagacaagagaaagggaaaagtcttctgtttaaaacagagaacggtgtgaacatgtgcaccctcatggccatggatcttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacagagaattgaaacttgggtcttgagacatccaggcttcaccataatggcagcaatcctggcatacaccataggaacgacatatttccaaagagtcctgattttcatcttactgacagctgttgctccctcaatgacaatgcgttgtataggaatatcaaatagagactttgtggaaggggtttcaggaggaagctgggttgacatagtcctggaacatggaagctgtgtgacgacgatggcaaaaaataaaccaacattggattttgaactgataaagacagaagcgaaacatcccgccactctaaggaagtattgcatagaggcaaagctgaccaacacaacaacagcatctcgctgcccaacacaaggagaacctagcctaaatgaagaacaggacaaaagatttgtctgcaaacactccatggtagatagaggatggggaaatggatgcggattatttggaaagggaggtatcgtgacctgtgcaatgttcacatgcaaaaagaacatggaagggaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttctaggatcccaagaaggggctatgcacacagcacttacaggggccacggaaatccagatgtcatcaggaaacttactgttcacaggacatcttaaatgtaggctgagaatggacaaactacagctcaaaggaatgtcatattccatgtgcacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccgggacaactgaagctcagctggtttaagaaaggaagctctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacttcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcatacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctaacagaaaatgaggtaaagttgactatcatgacaggagacattaaaggaatcatgcaggcaggaaaacgatccctgcggcctcaacccactgagctgaagtactcttggaaagcatggggcaaagcgaaagtgctctccacagagcttcataaccacacctttctcattgatggccccgaaacagcagaatgtcccaacacaaatagagcttggaactcactagaggttgaggactatggctttggagtattcaccactaacatatggctgaaattgaaagaaaggcaggatgtatcttgtgactcaaaactcatgtcggcagccataaaagacaacagagccgtccacgccgacatgggttattggatagaaagcgcactcaatgacacatggaagattgagaaagcctcctttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaaaactgtggaaatagaggaccctccttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgcttagaacccgagtagggacgaaacatgcaatattactagttgcagtctctttcgtgacattgatcacagggaacatgtcctttcgagatttggggagagtgatggtcatggtgggcgctactatgacggatgacataggcatgggcgtgacctatcttgccctattagcagccttcaaggtcagaccaacttttgcagctggactactcttaagaaagctgacctccaaggaattgatgatgaccaccataggaatcgtactcctctctcagagcaccataccagagaccatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacagcactggcagtggtgtccgtttccccactgcttttaacatcttcacagcagaaaacggattggataccactggcgttgacgatcaaaggccttaatccaacagccattttcttaacaaccctctcaagaactagtaagaaaaggagctggccactaaatgaggctattatggcagtcgggatggtgagcattttagccagttctttcttaaagaatgacattcccatgacaggaccactagtggctggagggcttctcactgtgtgttacgtgctcactggaagatcggctgatttggaactggagagagctgctgacataagatgggaagaacaggcagagatatcaggaagcagtccaattttgtcgataacaatatcggaagatggcagcatgtcgataaaaaatgaagaagaagaacaaacactgaccatactgattagaacaggactgctggtgatatcaggactttttcccgcgtcaataccaatcacggcagctgcatggtacctgtgggaagtgaaaaaacaacgagccggagtattgtgggatgtcccttcacctccacctgtgggaagggccgaactggaagacggagcctatagaatcaagcagaaagggattttgggatactcgcagataggagccggagtctacaaagaaggaactttccacacaatgtggcatgtcacacgtggtgctgttctaatgcataaagggaagagaattgaaccatcatgggcggacgtcaagaaggacctaatatcgtatggaggaggttggaagctagaaggagaatggaaggaaggagaagaagtccaggtcctggcattagagcctggaaagaatccaagagccgtccaaacaaaacccggtctttttaaaactaacactggaaccataggcgccgtatctctggacttttcccctggaacgtcaggatctccaattgtcgacaaaaaaggaaaagttgtgggcctttatggcaacggtgtcgtcacaaggagtggaacatacgtgagtgccatagcccagactgaaaaaagcattgaagacaacccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagtcgtggcggctgaaatggaagaagctctcagaggacttccaataagatatcaaaccccagctatcagagctgagcacactggacgggagattgtggatctaatgtgtcacgccacatttaccatgaggctactatcaccaattagagtgccaaattacaacctgattatcatggatgaagcccatttcacagacccagcaagcatagcggctagaggatacatctcaactcgagtagagatgggtgaagcagctgggatttttatgacagccacccctcctggaagcagagacccatttcctcagagcaacgcaccaatcatggatgaagaaagggaaattcctgagcgttcgtggaactctggacatgagtgggttacggattttaaagggaagactgtttggtttgttccaagtataaaagcaggaaatgatatagcagcttgcctgagaaagaatgggaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaacagacggtgaagaacgggttatcctggcaggacccatgccagtgacccactctagtgcagcacaaagaagagggagagtaggaagaaatccaaaaaatgaaaatgaccagtatatatacatgggggaacctctggaaaatgatgaagactgcgcacactggaaagaagctaagatgcttctagataacatcaacacgcctgaaggaatcattcccagcatgtttgaaccagagcgtgagaaggtcgacgccattgatggtgaataccgcttgagaggagaagcgaggaaaacatttgtggacctaatgagaagaggagacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcacttaaagaattcaaggaattcgcagctggaagaaaatccctgaccctgaatctaatcaccgagatgggtaggctcccaaccttcatgacccagaaagcaaggaatgcattggacaacttagcagtcctacacacggctgaagcaggcggaagggcgtacaatcatgctcttagtgaactgccggagactctggagacattgcttttactgacacttttggccacagtcacaggcggaatcttcctgttcttgatgagcggaaagggtatagggaagatgaccctgggaatgtgctgcatagtcacagccagtattcttctatggtatgcacaaatacagccacattggatagcagcttcaataatactggagttttttctcatagtcttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcatcacaacccagcaacctgagagcaacatcctggacatagatctacgtcctgcatcagcttggactctatatgctgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctatcggatgctattcacaagtcaaccccataaccctcacagcagcccttctcttattggtagcacattatgctatcatagggccaggactccaagcgaaagcaaccagagaggctcagaaaagagcagcagcgggcatcatgaaaaacccaactgtggatggaataacagtgattgacctagatccaataccatatgatccaaagtttgaaaagcagttgggacaagtaatgctcttagtcctctgcgtgactcaagtattgatgatgaggactacatgggctttatgtgaagctctaactttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagaaacgcttggagagaaatggaaaaaccggttgaatgcattggggaagagtgaattccagatctataagaaaagtggaatccaggaagtggatagaacgttagcaaaagaaggcatcaagagaggagaaacggaccatcacgctgtgtcgcgaggctcagcgaaactgagatggttcgtcgagagaaaccttgtcacaccagaagggaaagtagtggaccttggctgcggcagggggggctggtcatactattgtgggggactaaaaaatgtaaaggaagtcaaaggcctaacaaaaggaggaccaggacacgaagaacccattcccatgtcaacatatggttggaatctggtgcgtctgcaaagtggagtcgatgtcttttttactccgccagaaaagtgtgacacattgctgtgtgacataggggagtcgtcaccaaaccccacggtcgaggcaggacgaacactcagagttctaaacttagtggaaaactggctgaacaataatacccaattttgcataaaggttcttaatccatatatgccctcagttatagaaaaaatggaagcactacaaaggagatacggaggagctttggtgaggaatccaccctcacgaaattccacacacgagatgtactgggtatccaatgcttccgggaacatagtgtcatcagtgaacatgatttcaagaatgttgattaacagattcacaatgagacacaagaaggccacatacgagccggatgttgatctcggaagtggaacccgcaacatcggaattgaaagtgaagtaccaaatctagacataattgggaaaagaatagaaaaaataaaacaagagcatgaaacatcatggcactatgatcaagaccacccatacaaaacgtgggcctaccatggcagctacgaaacaaaacagactggatcagcatcatccatggtgaacggagtggttaggctgctaacaaaaccttgggacgtcatccccatggtgacacagatggcaatgacagacacgactccatttggacaacagcgcgttttcaaagagaaagtggacacgagaacccaagaaccaaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaagctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttggagtttgaagccctgggattcttgaatgaagatcactggttttccagagagaactccctgagtggagtagaaggagaagggctgcacaaactaggctacattctaagagacgtgagtaagaaagaaggaggagcaatgtacgccgatgacaccgcaggatgggacacaagaatcacgctagaggacttgaaaaatgaagaaatggtgacaaaccacatggaaggagaacacaagaaacttgctgaagccattttcagattaacgtaccaaaacaaagtggtgcgtgtgcaaagaccgacaccaagaggcacagtaatggacattatatcgagaagagaccaaagaggtagtggacaagttgtcacctacggcctcaacactttcaccaacatggaagcccaactgatcagacagatggagggagaaggagtcttcaaaagcatccagcacctgacagccacagaagaaattgcagtgaaaaactggttagtaagagtggggcgtgagaggttatcaagaatggccatcagcggagatgattgtgttgtgaaacccttcgatgacaggtttgcaaacgctctaacagctttaaatgacatgggaaaggtcaggaaagacatacaacaatgggaaccttcaagaggatggaacgattggacacaagtgcccttttgttcacaccatttccatgagttaatcatgaaggacggtcgtgtacttgtggttccatgtagaaaccaagatgaactgattggtagggcccgaatttcccagggagccgggtggtccttgcgggaaacagcttgtttggggaagtcttacgcccaaatgtggagcctaatgtacttccacagacgtgaccttaggctggcggcaaacgctatttgctcggcagtcccttcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaagagagaagaccagtggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagttttgtggtag

SEQ ID NO: 7065 - RNA, 9876 nt, synthetic construct
  misc_feature 1..9876: note = derived and/or modified CDS sequence (wt) from DENV-2__JQ955623__SS-prME
  source 1..9876: mol_type = other RNA
actgcaggcatgattatcatgctgattccaacagcgatggcgttccatttaactacacgcaacggagaaccacacatgatcgtcagcagacaagagaaagggaaaagtctcttgtttaaaacagaggatggtgtgaacatgtgtaccctcatggccatggaccttggtgaactgtgtgaagacacgatcacttataactgccctcttctcaggcagaatgaaccagaagacatagattgttggtgtaactccacgtccacatgggtaacttatgggacatgcactgccacaggagaacacagaagggaaaaaagatcagtggcactcgtcccacatgtgggtatgggattggagacacgaactgaaacatggatgtcatcagaaggggcctggaaacacgcccagagaattgaaacttggatcttgagacatccaggttttaccataatggcagcaatcttggcatacaccataggaacgacacatttccaaagagtcctgatcttcatcttactgacagctgtcgctccttcaatgacaatgcgttgtattggaatatcaaatagagactttgtggaaggggtttcaggaggaagctgggttgatatagtcctagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggttcgtctgcaaacattccatggtagacagaggatggggaaatggatgtggattatttggaaagggaggcatcgtgacctgtgctatgttcacatgcaagaaaaacatggaaggaaaaatcgtgcaaccagaaaacctggaatacaccattgtggtaacacctcactcaggggaagagaatgcagttggaaatgacacaggaaaacatggcaaggaaatcaaagtaacaccacagagttccattacagaagcagaactgacaggctatggcactgtcacgatggagtgctctccaagaacgggccttgacttcaatgagatggtgttgctgcaaatggaaaacaaagcttggctggtgcacaggcaatggttcttagacctgccgttaccatggttgcccggagcggacacacaaggatcaaattggatacagaaggagacattggtcaccttcaaaaatccccatgcgaagaaacaggatgttgttgttttaggatcccaagaaggggctatgcatacagcacttacaggggccacagaaatccagatgtcatcaggaaacctactgttcacaggacatctcaagtgcaggctgagaatggataaactacagctcaaaggaatgtcatactctatgtgtacaggaaagtttaaagttgtgaaagaaatagcagaaacacaacatggaacaatagttatcagagtacaatatgaaggggatggctctccatgtaaaatcccttttgagataatggacttggaaaaaagacatgtcttaggtcgcctgattacagtcaacccaatcgttacagaaaaagacagtccagtcaacatagaagcagaacctccattcggagacagctacatcattgtaggagtagaaccaggacaactgaagctcagctggtttaagaaaggaagttcaatcggccaaatgttcgagacaacaatgagaggagctaagagaatggccattttaggtgacacagcctgggattttggatccctgggaggagtgttcacatctataggaaaggccctccaccaagtttttggagcaatctatggggctgccttcagtggggtctcatggactatgaaaatcctcataggagtcgtcatcacatggataggaatgaattcacgcagcacctcactgtctgtgtcactagtattagtgggaatcgtgacattgtatttgggagtcatggtgcaggctgatagtggttgtgttgtgagttggaagaacaaagaactgaaatgtggcagtgggatttttatcacagacaatgtacacacgtggacagaacaatacaagtttcaaccagaatccccctcaaagctggcttcagctatccagaaagctcatgaagagggcatttgtggaatccgctcagtaacaagactggagaatttaatgtggaaacaaataacaccagaactgaatcacattctatcagaaaatgaggtaaagttgactatcatgacaggagacatcaaaggaatcatgcaggcaggaaaacgatccctgcggccccagcccactgagctgaagtattcatggaaaacgtggggcaaagcgaaaatgctctccacagagcctcataaccagacttttctcattgatggccccgaaacagcagaatgtcccaacacaaacagagcttggaactcactagaagttgaagactatggctttggggtattcaccaccaatatatggctgaagttgaaagaaaggcaggatgtgttttgtgactcaaaactcatgtcagcggccataaaagacaacagagccgtccatgccgacatgggttattggatagaaagcgcacttaatgacacatggaagatagaaaaagcttcttttatcgaagttaaaagttgccactggccaaaatcacacactctctggagtaatggagtgctggaaagtgaaatgataattccaaagaactttgctggaccagtatcacaacacaattacagaccaggctatcacacacaaacggcaggaccctggcatctaggcaagcttgagatggactttgatttttgcgaaggaaccacagtagtggtgactgaggattgtggaaatagaggaccctctctaagaacaaccaccgcctccggaaaactcataacagaatggtgttgccgatcctgcacattaccaccactaagatacagaggtgaggatgggtgctggtacggaatggaaatcagaccattgaaagagaaagaagagaacttggttaattctttggtcacagccggacatggacagattgacaacttctcactaggagtcttgggaatggcactgttcctggaagaaatgctcaggacccgagtaggaacaaaacatgcagtattactagttgcagtttctttcatgacattgatcacagggaacatgtcttttcgagacctagggagagtgatggttatggtgggggctgctatgacggatgacataggcatgggcgtgacttatcttgccttattagcagccttcaaagttagaccaacttttgcagctggactacttttgagaaagctgacctccaaggaattgatgatgaccaccataggaatcgtactcctctcccagagcaccataccagagactatacttgaactgactgatgcgttagccttgggcatgatgattctcaagatagtgagaaatatggaaaagtatcaattagcagtgactatcatggctatcttatgtgttccaaatgcagtgatattacaaaatgcatggaaagtgagctgcacaatactggcagtggtgtctgtttccccactgctcttaacatcttcacagcagaaagcggattggataccattggcattgacgatcaaaggtctcaacccaacagccattttcctaacaaccctttcaagaactaacaagaaaaggagttggccactaaatgaggctatcatggcagtcgggatggtgagcattttagccagttctctcttgaagaatgacattcccatgacaggaccattagtggctggagggcttctcactgtgtgttacgtgctcactggaagatcggctgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattaggacaggattgctggtgatatcaggactttttcccgtatcaataccaatcacggcagcagcatggtacctgtgggaagtgaagaaacaacgggctggagtattgtgggatgtcccttcacccccacctgtgggaaaggccgaactggaagatggagcttatagaatcaagcagaaagggattcttggatactcccagatcggagctggagtttacaaagaaggaacattccacacaatgtggcatgtcacacgtggtgctgttctaatgcataaagggaagaggattgaaccatcatgggcagatgtcaggaaagacctaatatcgtatggaggaggctggaagctagaaggagaatggaaggaaggagaagaagtccaggtcttggcattagagcctgggaagaatccaagagccgtccaaacaaaacccggtctttttaaaactaacaccggaaccataggcgctgtatctttagacttttctcctggaacgtcaggatctccaatcgtcgacaaaaaaggaaaagtcgtgggtctctatggcaatggtgtcgtcacaaggagtggaacatatgtgagtgccatagcccagactgaaaaaagcattgaagacaatccagagattgaagatgacatctttcgaaaaaaaagattgaccattatggacctccacccaggagcgggaaaaacgaaaagataccttccagcaatagtcagagaggccataaaacgaggcttaagaacattaatcctggcccccactagagtcgtagcagctgaaatggaggaagctcttagaggacttccgataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacggacccagcaagcatagcagctagaggatacatttcaactcgagtagagatgggtgaagcagctgggattttcatgacagccactcctccgggaagcagagacccatttccccagagcaatgcaccaatcatggatgaagaaagggaaatccctgaacgttcgtggaattctggacatgagtgggttacagattttaaagggaagactgtttggtttgttccgagtataaaagcaggaaatgacatagcagcttgcctgagaaaaaatggaaagaaagtgatacaactcagtagaaagacctttgattctgaatacatcaagactaggaccaatgactgggactttgtggtcacgactgacatctcagaaatgggtgctaacttcaaggctgaaagggttatagaccccaggcgctgcatgaaaccagtcatactaacagacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcatccccagcatgttcgaaccagagcgtgaaaaggtggatgccattgatggtgagtaccgcttaagaggagaagcgaggaaaacctttgtggacctaatgagaagaggagacctaccagtctggctggcctacagagtggcagccgaaggcattaactatgcagacagaaggtggtgctttgatggaatcaagaacaaccaaatcttggaagaaaatgtggaagtggaaatctggacaaaagaaggggaaaggaagaaattgaaacccagatggttggatgctaggatctactctgacccactggcgctcaaagaattcaaagagtttgcagctggaagaaaatccctgaccctgaatttaatcacagaaatgggtaggcttccaacttttatgactcagaaagcaaggaacgcactggacaacttggcagtcctgcatacggctgaagcaggcggaagggcgtacaatcatgctctcagtgaattgccagagaccctggagacattgcttttgctgacacttttggccacagtcacgggcggaatctttttattcttgatgagtggaaaaggtatagggaaaatgaccctgggaatgtgctgcataatcacggccagtattctcctatggtacgcacaaatacagccacactggatagcggcttcaataatactggagttctttctcatagtcttgctcattccagagccagaaaagcagagaacaccccaagataaccaattgacttacgttgtcatagccatcctcacagtggtggccgcaaccatggcaaatgagatggggttcttggaaaaaacgaagaaagatttcggattgggaagcattgcaacccagcaactcgagagcaacatcctggacatagatctacgtcctgcatcagcatggaccctgtatgcagtggccacaacatttatcacaccaatgctgagacatagcattgaaaattcctcagtgaatgtgtctctaacagctattgccaatcaagccacagtgctaatgggtcttgggaagggatggccattgtcaaaaatggacattggagttccccttctcgccatcgggtgctattcacaagtcaaccccataaccctcacagcagcccttcttctattggtagcacattatgctatcatagggccaggactccaagcaaaagcaaccagagaagcgcagaaaagagcagcagcaggcatcatgaaaaacccaactgtggatggaataacagtgattgacctagatccaataccctatgatccaaaatttgagaagcagctgggacaagtaatgctcttagtcctctgcgtgactcaagtactgatgatgaggactacatgggctttgtgtgaggctctaaccctagccaccgggcccatctccacattgtgggaaggaaatccagggagattttggaatacaaccattgcagtgtcaatggctaacatttttagaggaagttacttggctggagctggacttctcttttccattatgaagaacacaaccaacacaagaaggggaactggcaacacaggagagacgcttggagagaaatggaaaaaccgattgaattcattggggaagagtgaattccagatctacaagagaagcggaatccaggaagtggatagaaccttggcaaaagaaggcattaaaagaggagaaacggaccatcacgctgtgtcgcgaggctcggcaaagctgagatggttcgtcgagagaaacctggtcacaccagaggggaaagtagtggacctcggttgcggtagaggaggctggtcatactattgtgggggtctaaagaatgtaagagaagtcaaaggcctaacaaaaggaggaccaggacacgaagagcccattcccatgtcaacatatgggtggaaccttgtgcgtctccaaagtggagttgatgttttctttactccgccagaaaagtgtgacacattgttgtgtgacataggggagtcgtcaccaaaccccacagttgaagcaggacgaacactcagagtcctaaacttggtagaaaattggctgaacaacgacacccaattttgcataaaggttcttaacccatacatgccttcagtcatagaaaaaatggaagcgctgcaaagaaaatacggaggagctttggtgaggaatccactctcgagaaattctacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaattgaaagcgagacaccaaacctagacataattgggaaaagaatagaaaaaataaaacaagagcatgagacatcatggcattatgaccaagaccacccatacaaaacgtgggcctatcatggtagctacgaaacaaaacagactggatcagcatcatccatggtgaatggagtagttagattgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaggaaagaaaaagacacctagaatgtgcactagagaagaattcacaagaaaggtgagaagcaatgcagccttgggtgccatattcactgatgagaacaagtggaagtcggcacgtgaggctgttgaagacagtagattttgggaactggttaacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggattcctgaatgaagatcactggttttccagagagaactctctgagcggagtggaaggagaagggctgcacaagctgggttacattctaagagaagtgagtaagaaagaaggaggagcaatgtacgccgacgacactgctggatgggacacaagaatcacactagaggacttaaaaaatgaagaaatggtgacaaaccacatggaaggagaacacaagaaacttgctgaggccattttcaaattgacgtaccagaacaaggtggtgcgtgtgcaaagaccgacaccaagaggcactgtaatggatattatatcgagaagagaccaaagaggtagtggacaagttggcacctatggcctcaacaccttcaccaatatgggagcccaactaatcagacagatggagggagaaggagtctttaagggcatccagcacctgacagccacagaagaaaccgcagtgcatgactggctagcaagagtggggcgtgagaggttatcaagaatggccatcagtggagatgattgtgttgtgaaacccttagatgacaggtttgcaagcgctttaacagctctaaacgacatgggaaaggttaggaaagacatacaacaatgggaaccttcaagaggatggaatgactggacacaagtgcctttctgttcacaccacttccatgagttaatcatgaaagacggtcgtgtactcgtagttccatgtagaaaccaagatgaactaattggtagagcccgaatttcccagggagccgggtggtctttgcgggagacggcctgtctgggaaagtcttacgcccaaatgtggagcctgatgtacttccacagacgtgacctcaggctggcggcaaacgctatttgctcggcagtcccatcacattgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgtggctcactgatagggctaacaagcagagctacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 7066 - RNA, 9876 nt, synthetic construct
  misc_feature 1..9876: note = derived and/or modified CDS sequence (wt) from DENV-2__KR779782__SS-prME
  source 1..9876: mol_type = other RNA
actgcaggtataattattatgatgatcccaacagtgatggcgttccatttaaccacacgcaacggagaaccacacatgatcgttagcagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaacaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagaacgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaatttgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgttgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacattggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttaggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaatcgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagtttggcaaagcaaaaggcagcagagccatatggtacatgtggcttggagcacgcttcttagagtttgaagctctaggattcttgaacgaagatcactggttttccagagagaactccctgagtggagtggaaggagaagggctacacaaactaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7067 - RNA, 9876 nt, synthetic construct
  misc_feature 1..9876: note = derived and/or modified CDS sequence (wt) from DENV-2__KM279608__SS-prME
  source 1..9876: mol_type = other RNA
actgcaggtataattattatgatgatcccaacagtgatggcgttccacttaaccacacgcaacggagaaccacacatgatcgtgagtagacaagagaaggggaaaagtctcctgtttaaaacagagaacggtgtgaacatgtgtaccctcatggccatggaccttggtgaactgtgtgaagacacaatcacatataactgtcctcttctcaggcagaatgaaccagaagacatagactgttggtgcaactctacgtctacatgggtaacttatgggacatgcaccgtcacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatacctccaaagagtcctgattttcattttactgacagctgtcactccttcaatggcaatgcgttgtataggaatatcaaatagagactttgtggaaggggtttcaggaggaagctgggtcgatatagtcttggaacatggaagctgtgtgacgacgatggcgaaaaataaaccaacattggattttgaactgataaaaacagaagccaaacatcccgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggtctcgacttcaatgagatggtgttgctgcaaatggaaaacaaggcttggctggtgcacaggcaatggttcttagacctgccgttaccatggttgcccggagcagacacacaaggatcaaattggatacagaaggagacactggtcaccttcaaaaatccccatgcaaagaaacaggatgttgttgttttaggatcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacaacccagtcaacatagaagcagaacctccatttggagacagctacatcattataggagtagaaccgggacaactgaagctcagctggtataagaaaggaagttctattggccaaatgtttgagacaacaatgagaggagcgaagagaatggccattttaggtgacacagcttgggattttggatccctgggaggagtgttcacatccataggaaaggccctccaccaagtctttggagctatctatggggctgccttcagcggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggagaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacggaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtgttcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcgatattactagttgcagtctctttcgtgacattgatcacagggaatatgtcctttcgagatttggggagagtgatggtcatggtgggcgctactatgacggatgacataggcatgggcgtgacttatcttgccctattagcagccttcaaagttagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccgaatgcagtgatattggaaaacgcatggaaagtgagctgcacaacactggcagtggtgtccgtctccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgacattcccatgacaggaccattagtggctggagggcttctcactgtgtgttacgtgctcactggaagatcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcaccgccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagagtggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcagggaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagacagtttggtttgttccaagtataaaagcagggaatgatatagcagcttgcctgagaaagaatggaaagaaagtgatacaactcagcaggaagacttttgattctgaatatatcaagactaggaccaatgattgggactttgtggtcacgacagacatttcagaaatgggtgctaacttcaaggctgagagggttatagaccccagacgctgcatgaaaccagtcatattaacggacggtgaagagcgggtgattttggcaggacccatgccagtgacccattctagtgcagcacaaagaagagggagagtaggaagaaatccaaaaaatgaaaatgaccagtacatatacatgggggaacctctggaaaatgatgaagactgtgcacattggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacaaagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaacctttatgacccagaaagcaaagaatgcactcgacaacttagcagttctgcatacggctgaagcaggcggaagggcgtacaatcatgctcttagtgaactgccggagactctggagacattgcttttactgacacttttggccacagtcacgggcggaatcttcctgtttttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaaccttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagttaaccccataactctcactgcagcccttctcttattggtagcccattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattggggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtggtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgacgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggttctcaacccatacatgccttcagttatagagaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacgatgagacacaagaaagccacatacgagccagatgttgacctcggaagtggaacccgcaacatcggaattgaaagtgagacaccaaatttagacataattgggaaaagaataaaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaaactaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaaactaggctacattttaagggacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacatcatatcgagaagagaccaaagaggtagtggacaagttgtcacctacggcctcaatactttcaccaatatggaagcccaactgatcagacagatggaaggagaaggagtcttcaaaagcatccagcaactgacagttaaagaagaaattgcagtgaaaaactggttaataagagtggggcgtgagaggttatcaagaatggctatcagtggagatgattgtgttgtgaaacccttagatgacaggtttgcaagtgctctaacagctctaaatgacatgggaaaagttaggaaagacatacaacaatgggaaccttcaagaggatggaacgattggacacaagtgcccttttgttcacaccatttccatgagttgatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagagtcatgggaggaaatcccgtatttggggaaaagagaagaccaatggtgcggctcattgattgggctgacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7068 - RNA, 9876 nt, synthetic construct
  misc_feature 1..9876: note = derived and/or modified CDS sequence (wt) from DENV-2__KM279605__SS-prME
  source 1..9876: mol_type = other RNA
actgcaggtataattattatgatgatcccaacagtgatggcgttccacttaaccacacgcaacggagaaccacacatgatcgtgagtagacaagagaaggggaaaagtctcctgtttaaaacagagaacggtgtgaacatgtgtaccctcatggccatggaccttggtgaactgtgtgaagacacaatcacatataactgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatacttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacattggattttgaactgataaaaacagaagccaaacatcccgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggtctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggatcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacaacccagtcaacatagaagcagaacctccatttggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatccataggaaaggccctccaccaagtctttggagctatctatggggctgccttcagcggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgtgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacggaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtgttcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaatatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattggaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgacattcccatgacaggaccattagtggctggagggcttctcactgtgtgttacgtgctcactggaagatcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcaccgccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagagtggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattctgaatatatcaagactaggaccaatgattgggactttgtggtcacgacagacatttcagaaatgggtgctaacttcaaggctgagagggttatagaccccagacgctgcatgaaaccagtcatattaacggacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacattggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacaaagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgtttttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagttaaccccataactctcactgcagcccttctcttattggtagcccattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattggggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaaactaggctacattttaagggacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacatcatatcgagaagagaccaaagaggtagtggacaagttgtcacctacggcctcaatactttcaccaatatggaagcccaactgatcagacagatggaaggagaaggagtcttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaagttaggaaagacatacaacaatgggaaccttcaagaggatggaacgattggacacaagtgcccttttgttcacaccatttccatgagttgatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagagtcatgggaggaaatcccgtatttggggaaaagagaagaccaatggtgcggctcattgattgggctgacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7069 - RNA, 9876 nt, synthetic construct
  misc_feature 1..9876: note = derived and/or modified CDS sequence (wt) from DENV-2__KM279609__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgtgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7070 - RNA, 9876 nt, synthetic construct
  misc_feature 1..9876: note = derived and/or modified CDS sequence (wt) from DENV-2__KM279607__SS-prME
  source 1..9876: mol_type = other RNA
actgcaggtataattattatgatgatcccaacagtgatggcgttccacttaaccacacgcaacggagaaccacacatgatcgtgagtagacaagagaaggggaaaagtctcctgtttaaaacagagaacggtgtgaacatgtgtaccctcatggccatggaccttggtgaactgtgtgaagacacaatcacatataactgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactagagacacgaactgaaacatggatgtcatcagaaggggcctggaaacatgcccagagaattgaaacttggatcttgagacatccaggcttcaccataatggcagcaatcctggcatacaccataggaacaacatacctccaaagagtcctgattttcattttactgacagctgtcactccttcaatggcaatgcgttgtataggaatatcaaatagagactttgtggaaggggtttcaggaggaagctgggtcgatatagtcttggaacatggaagctgtgtgacgacgatggcgaaaaataaaccaacattggattttgaactgataaaaacagaagccaaacatcccgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggtctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggatcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacaacccagtcaacatagaagcagaacctccatttggagacagctacatcattataggagtagaaccgggacaactgaagctcagctggtataagaaaggaagttctattggccaaatgtttgagacaacaatgagaggagcgaagagaatggccattttaggtgacacagcttgggattttggatccctgggaggagtgttcacatccataggaaaggccctccaccaagtctttggagctatctatggggctgccttcagcggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgtgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacggaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtgttcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaatatgtcctttcgagatttggggagagtgatggtcatggtgggcgctactatgacggatgacataggcatgggcgtgacttatcttgccctattagcagccttcaaagttagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccgaatgcagtgatattggaaaacgcatggaaagtgagctgcacaacactggcagtggtgtccgtctccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgacattcccatgacaggaccattagtggctggagggcttctcactgtgtgttacgtgctcactggaagatcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcaccgccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagagtggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattctgaatatatcaagactaggaccaatgattgggactttgtggtcacgacagacatttcagaaatgggtgctaacttcaaggctgagagggttatagaccccagacgctgcatgaaaccagtcatattaacggacggtgaagagcgggtgattttggcaggacccatgccagtgacccattctagtgcagcacaaagaagagggagagtaggaagaaatccaaaaaatgaaaatgaccagtacatatacatgggggaacctctggaaaatgatgaagactgtgcacattggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacaaagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaacctttatgacccagaaagcaaagaatgcactcgacaacttagcagttctgcatacggctgaagcaggcggaagggcgtacaatcatgctcttagtgaactgccggagactctggagacattgcttttactgacacttttggccacagtcacgggcggaatcttcctgtttttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagttaaccccataactctcactgcagcccttctcttattggtagcccattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattggggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgacgttttttttactccgccagaaaagtgtgacacattgctgtgtgacataggggagtcgtcaccaaaccccacggttgaggcaggacgaacactcagagttctaaacttagtggaaaattggctgaacaacaacacccaattttgcataaaggttctcaacccatacatgccttcagttatagaaaaaatggaagcactacaaaggaaatacggaggagctttggtgaggaatccactctcacgaaattccacacacgagatgtattgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaagctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaaactaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaaactaggctacattttaagggacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacatcatatcgagaagagaccaaagaggtagtggacaagttgtcacctacggcctcaatactttcaccaatatggaagcccaactgatcagacagatggaaggagaaggagtcttcaaaagcatccagcaactgacagttaaagaagaaattgcagtgaaaaactggttaataagagtggggcgtgagaggttatcaagaatggctatcagtggagatgattgtgttgtgaaacccttagatgacaggtttgcaagtgctctaacagctctaaatgacatgggaaaagttaggaaagacatacaacaatgggaaccttcaagaggatggaacgattggacacaagtgcccttttgttcacaccatttccatgagttgatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagagtcatgggaggaaatcccgtatttggggaaaagagaagaccaatggtgcggctcattgattgggctgacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7071 - RNA, 9876 nt, synthetic construct
  misc_feature 1..9876: note = derived and/or modified CDS sequence (wt) from DENV-2__KM279606__SS-prME
  source 1..9876: mol_type = other RNA
actgcaggtataattattatgatgatcccaacagtgatggcgttccacttaaccacacgcaacggagaaccacacatgatcgtgagtagacaagagaaggggaaaagtctcctgtttaaaacagagaacggtgtgaacatgtgtaccctcatggccatggaccttggtgaactgtgtgaagacacaatcacatataactgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatacttccaaagagtcctgattttcattttactgacagctgtcactccttcaatggcaatgcgttgtataggaatatcaaatagagactttgtggaaggggtttcaggaggaagctgggtcgatatagtcttggaacatggaagctgtgtgacgacgatggcgaaaaataaaccaacattggattttgaactgataaaaacagaagccaaacatcccgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggtctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggatcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacaacccagtcaacatagaagcagaacctccatttggagacagctacatcattataggagtagaaccgggacaactgaagctcagctggtataagaaaggaagttctattggccaaatgtttgagacaacaatgagaggagcgaagagaatggccattttaggtgacacagcttgggattttggatccctgggaggagtgttcacatccataggaaaggccctccaccaagtctttggagctatctatggggctgccttcagcggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacggaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggttttggagtgttcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaatatgtcctttcgagatttggggagagtgatggtcatggtgggcgctactatgacggatgacataggcatgggcgtgacttatcttgccctattagcagccttcaaagttagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattggaaaatgcatggaaagtgagctgcacaacactggcagtggtgtccgtctccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgacattcccatgacaggaccattagtggctggagggcttctcactgtgtgttacgtgctcactggaagatcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcaccgccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagagtggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattctgaatatatcaagactaggaccaatgattgggactttgtggtcacgacagacatttcagaaatgggtgctaacttcaaggctgagagggttatagaccccagacgctgcatgaaaccagtcatattaacggacggtgaagagcgggtgattttggcaggacccatgccagtgacccattctagtgcagcgcaaagaagagggagagtaggaagaaatccaaaaaatgaaaatgaccagtacatatacatgggggaacctctggaaaatgatgaagactgtgcacattggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacaaagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaacctttatgacccagaaagcaaagaatgcactcgacaacttagcagttctgcatacggctgaagcaggcggaagggcgtacaatcatgctcttagtgaactgccggagactctggagacattgcttttactgacacttttggccacagtcacgggcggaatcttcctgtttttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctattgggtgctattcacaagttaaccccataactctcactgcagcccttctcttattggtagcccattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggccaacatttttagagggagttacctggccggagccggacttctcttttctatcatgaaaaacacggccaacacaagaaggggaactggcaacacaggagagacgcttggagagaaatggaaaaaccggttgaatgcattggggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgacgttttttttactccgccagaaaagtgtgacacattgctgtgtgacataggggagtcgtcaccaaaccccacggttgaggcaggacgaacactcagagttctaaacttagcggaaaattggctgaacaacaacacccaattttgcataaaggttctcaacccatacatgccttcagttatagaaaaaatggaagcactacaaaggaaatacggaggagctttggtgaggaatccactctcacgaaattctacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaaactaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaaactaggctacattttaagggacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacatcatatcgagaagagaccaaagaggtagtggacaagttgtcacctacggcctcaatactttcaccaatatggaagcccaactgatcagacagatggaaggagaaggagtcttcaaaagcatccagcaactgacagttaaagaagaaattgcagtaaaaaactggttaataagagtggggcgtgagaggttatcaagaatggctatcagtggagatgattgtgttgtgaaacccttagatgacaggtttgcaagtgctctaacagctctaaatgacatgggaaaagttaggaaagacatacaacaatgggaaccttcaagaggatggaacgattggacacaagtgcccttttgttcacaccatttccacgagttgatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagagtcatgggaggaaatcccgtatttggggaaaagagaagaccaatggtgcggctcattgattgggctgacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7072 - RNA, 9876 nt, synthetic construct
  misc_feature 1..9876: note = derived and/or modified CDS sequence (wt) from DENV-2__JN851113__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccatcttcttaacaactctctcaagaactagcaagaaaaggagctggccactaaatgaggctattatggcagtcgggatggtgagcattctagccagttctctcttaaagaatgatattcccatgacaggaccattagtggctggagggctcctcactgtgtgttatgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaataacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaaactaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7073 - RNA, 9876 nt, synthetic construct
  misc_feature 1..9876: note = derived and/or modified CDS sequence (wt) from DENV-2__GU370050__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatcccgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctatggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttctccgtgcaagatcccttttgaaataatggacttggaaaaaaggcatgtcttaggtcgcttgattacagtcaacccaattgtcacagaaaaagacagcccagtcaacatagaagcagaacctccatttggagacagctacatcattataggagtagaaccaggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaagcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtgtcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggccatcttgtgcgtcccaaatgcagtgatattgcaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagccagttctctcttaaagaatgatattcccatgacaggaccattagtggctggagggcttctcactgtgtgttacgtgctcactggaagatcggctgatttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcattagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcttaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagctacccctcctggaagcagagacccatttccccagagcaatgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcctggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatattgaggcatagcattgaaaactcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggagagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagttaaaggcctaacaaaaggaggaccaggacacgaagaacccattcccatgtcaacatatggttggaatctggtgcgtcttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttctcaacccatacatgccctcagttatagaaaaaatggaagcactacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcataaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcagattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagttaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccctgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 7074 - RNA, 9876 nt, synthetic construct
  misc_feature 1..9876: note = derived and/or modified CDS sequence (wt) from DENV-2__JN851129__SS-prME
  source 1..9876: mol_type = other RNA
actgcaggtataattattatgatgattccaacagtgatggcgttccatttaaccacacgcaacggagaaccacatatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaattctacgtctacatgggtaacttatgggacgtgcaccgccacaggagaacacagaagggaaaaaagatcagtggcactcgttccacatgtaggaatgggactggagacacgaactgagacatggatgtcatcagaaggggcctggaaacatgcccagagaattgaaacttgggtcttgagacatccaggctttaccataatggcagcaatcctggcatacaccataggaacgacatatttccaaagagtcctgattttcatcttactgacagctgtcgctccctcaatgacaatgcgttgtataggaatatcaaatagagactttgtggaaggggtctcaggaggaagctgggttgacatagtcttggaacatggaagctgtgtgacgacgatggcgaaaaataaaccaacattggattttgaactgataaaaacagaggccaagcatcccgccactctaaggaagtattgtatagaggcaaagctgaccaacacaacaacagcttctcgctgcccaacacaaggagaacctagcctaagtgaagaacaggacaaaagatttgtctgcaaacactccatggtagacagaggatggggaaatggatgcggattatttggaaaaggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctccccgagaacgggcctcgacttcaatgagatggtgttgctgcaaatggaaaacaaggcttggctggtgcacaggcaatggttcttagacttgccgttgccatggttgcccggagcagacacacaaggatcaaattggatacagaaggagacattggtcactttcaaaaatccccacgcaaagaaacaggatgttgttgtcttaggatcccaagaaggggctatgcacacagcactcacaggggctacggaaatccagatgtcatcaggaaacttactgttcacaggacaccttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgtaagatcccttttgaaataatggatttggaaaaaagacatgtcttaggtcgcttgattacagtcaacccaattgtcacagaaaaagacagcccagtaaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaatgtgcacacatggacagaacaatacaaattccaaccagaatccccttcaaagctggcttcagctattcagaaggctcatgaagaaggcatttgtggaattcgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtattcaccaccaacttatggctgaaattgaaagaaaggcaggatgtattttgtgactcaaaactcatgtcggcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagagttttgcaggaccagtgtcacaacacaattacagaccaggctatcatacacaaacggcaggaccctggcatctaggtaggcttgagatggactttgatttctgcgaaggaactacagtggtggtgactgaggactgtggaaatagaggaccctctttaagaacaactactgcttctggaaaactcataacagagtggtgctgccgatcttgcacattaccaccgctaaggtacagaggtgaggatggatgctggtatggaatggaaatcagaccattgaaagagaaagaagagaacttggtcaactccttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagacttggggagagtgatggtcatggtgggcgctactatgacggatgacataggcatgggcgtgacttatcttgccctattagcagccttcaaagttagaccaacttttgcagctggactactcttaagaaagctgacctccaaggaattgatgatgaccaccataggaatcgtactcctctctcagagcaccataccggagactatacttgaactaaccgacgcgttggccttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgctgacgatcaaaggcctcaatccaacagccatcttcttaacaaccctctcaagaactagcaagaaaaggagctggccactgaatgaggctattatggcagtcgggatggtgagcattttagccagttctctcttaaagaatgatattcccatgacaggaccattagtggctggagggcttctcactgtgtgttacgtgctcactggaagatcggctgacttggaactggagagagctgctgacgtaagatgggaagaacaagcagagatatcaggaagtagtccaattctatcgataacaatatcggaagatggtagcatgtcgataaaaaatgaagaagaagaacaaacactgaccatactcattagaacaggactgctggtgatatcaggactttttcccgtgtcaatacccatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagccggagtttacaaggaaggaacattccacacaatgtggcatgtcacacgtggagccgtcctaatgcataaagggaagagaattgaaccatcatgggcggacgtcaagaaagacctgatatcgtatggaggaggctggaagttagaaggagaatggaaggaaggagaagaagtccaggtcctggctttagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaaaagataccttccagcaatagtcagagaagccataaaacgaggcttgagaacactaatcctggcccccactagagttgtggcggctgaaatggaagaagctctcagaggacttccaataagataccaaaccccagctatcagagctgagcacaccgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcagggaatgatatagcagcttgcctgagaaagaatggaaagaaagtgatacaactcagcaggaagacttttgattctgaatatatcaagactaggactaatgactgggactttgtggtcacgacagacatttcagaaatgggtgctaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaggctaagatgcttctagataacatcaacacgcctgaaggaatcattcccagcatgttcgaaccagagcgtgaaaaggtggacgccattgatggtgaataccgcttgagaggagaagcgaggaaaacttttgtggacctaatgagaagaggagacctaccagtctggctagcctacagagtggcagctgaaggtatcaactacgcagacagaagatggtgctttgatggaatcaagaacaaccaaatcttggaagaaaatgtggaagtggaaatttggacaaaagaaggagaaaggaagaaattaaaacccagatggttggatgctagaatctactctgatccactggcgctcaaagaattcaaggaattcgctgctggaagaaaatccctgaccctgaatctaatcacagagatgggtaggctcccaaccttcatgacccagaaagcaaggaatgcactggacaacctagcagtcctgcatacggctgaagcaggcggaagggcgtacaatcatgctcttagtgaactgccggagactctggagactctgcttttactgacacttttggccacagtcacgggtggaatcttcctgttcttgatgagcggaaaaggtatagggaagatgactctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgaggcatagcattgaaaattcctcagtgaatgtgtctctaacagccattgccaaccaagctacagtgctaatgggtcttgggaagggatggccattgtcaaaaatggacattggagttccccttctcgctatcgggtgctattcacaagtcaaccccataactctcacagcagcccttctcttattggtagcacattatgctatcataggaccaggactccaggcgaaagcaactagagaggctcagaaaagagcagcagcgggcatcatgaaaaacccaactgtggatggaataacagtgattgacctagatccaataccctatgatccaaagtttgaaaagcagttgggacaggtaatgctcttagtcctctgcgtgactcaagtattgatgatgaggactacatgggctttatgtgaagctctaaccttagcaaccgggcccatctctacactgtgggaaggaaatccagggagattttggaacacaactattgcagtgtcaatggctaacatttttagagggagttacctggccggagccggacttctcttttccatcatgaagaacacggccaacacaagaaggggaactggcaacacaggagagacgcttggagagaaatggaaaaaccggttgaatgcattgggaaagagtgaattccagatctataagaaaagtggaatccaggaagtggatagaaccttagcaaaagaaggcatcaaaagaggagaaacggaccatcacgctgtgtcgcgaggctcagcgaaactgagatggttcgtcgagagaaacttggtcacaccagaagggaaagtagtggaccttggctgcggcagggggggctggtcatactattgtgggggactaaagaatgtaaaagaagtcaaaggcttaacaaaaggaggaccaggacacgaagaacccattcccatgtcaacatatggttggaatctggtgcgtcttcaaagtggagttgatgtttttttcactccgccagaaaagtgtgacacattgctgtgtgacataggggagtcgtcaccaaaccccacggttgaagcaggacgaacactcagagttctaaacttagtggaaaattggctgaacaacaacacccaattttgcataaaggttctcaacccatacatgccctcagttatagaaaaaatggaagcgctacaaaggaaatacggaggagctttggtgaggaatccactctcacgaaattccacacatgagatgtactgggtatctaatgcttccgggaacatagtgtcatcagtgaacatgatttcaagaatgttgattaacagattcacaatgagacacaagaaggccacgtacgagccagatgttgacctcggaagtggaacccgcaacatcggaattgaaagtgagacaccaaatttagacataattgggaaaagaatagaaaaaataaagcaagagcatgaaacatcatggcactatgaccaagaccacccatacaaaacgtgggcctaccatggtagctacgaaacaaaacagactggatcagcatcatccatggtgaacggagtggttaggctgctaacaaaaccttgggacatcatccctatggtgacacagatggcaatgacagacacgactccatttggacaacagcgcgtcttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagaaaagaagctaggggagtttggcaaagcaaaaggcagcagagccatatggtacatgtggcttggagcacgcttcttagaatttgaagccctaggattcctgaatgaagatcactggttttccagagagaactccctgagtggagtggaaggagaagggctgcacaaactaggctacattttaagagacgtgagtaagaaagagggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacaaatggagggagaaggagtcttcaaaagtatccagcaattgacagtcacagaagaaattgcagtgaaaaactggttagtaagagtggggcgtgagaggttatcaagaatggccatcagtggagatgattgtgttgtgaaacccttagatgacaggtttgcaagcgccctaacagccctaaatgacatgggaaaggttaggaaagacatacaacaatgggaaccttcaagaggatggaacgattggacacaagtgcccttttgttcacaccattttcatgagttaatcatgaaggacggtcgtgtactcgtagtcccatgcagaaaccaagatgaactgattggtagggcccgaatttcccagggagccggatggtccctgcgggaaacagcctgtttggggaagtcttacgcccaaatgtggagcctgatgtacttccacagacgtgaccttaggctggcggcaaatgccatttgctcggcagtcccatcacactgggttccaacaagtcgaacaacctggtccatacacgccacacatgagtggatgacaacagaagacatgctgacagtctggaacagggtgtggattcaagaaaacccatggatggaagacaaaactctagtagaatcatgggaagaaatcccatatttggggaaaagagaagaccaatggtgcggctcattgattgggctaacaagcagggccacctgggcgaagaacatccaaacagcgataaatcaagttagatccctaataggcaatgaggaatacacagactacatgccatccatgaaaagattcagaagagaagaggaagaggcaggagtcttgtggtag

SEQ ID NO: 7075 - RNA, 9876 nt, synthetic construct
  misc_feature 1..9876: note = derived and/or modified CDS sequence (wt) from DENV-2__JN851128__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaattctacgtctacatgggtaacttatgggacgtgcaccgccacaggagaacacagaagggagaaaagatcagtggcactcgttccacatgtaggaatgggactggagacacgaactgagacatggatgtcatcagaaggggcctggaaacatgcccagagaattgaaacttgggtcttgagacatccaggctttaccataatggcagcaatcctggcatacaccataggaacgacatatttccaaagagtcctgattttcatcttactgacagctgtcgctccctcaatgacaatgcgttgtataggaatatcaaatagagactttgtggaaggggtctcaggaggaagctgggttgacatagtcttggaacatggaagctgtgtgacgacgatggcgaaaaataaaccaacattggattttgaactgataaaaacagaggccaatcatcccgccactctaaggaagtattgtatagaggcaaagctgaccaacacaacaacagcatctcgctgcccaacacaaggagaacctagcctaagtgaagaacaggacaaaagatttgtctgcaaacactccatggtagacagaggatggggaaatggatgcggattatttggaaaaggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggttatggcactgtcacgatggaatgctccccgagaacgggcctcgacttcaatgagatggtgttgctgcaaatggaaaacaaggcttggctggtgcacaggcaatggttcttagacctgccgttgccatggttgcccggagcagacacacaaggatcaaattggatacagaaggagacattggtcactttcaaaaatccccacgcaaagaaacaggatgttgttgtcttaggatcccaagaaggggctatgcacacagcactcacaggggctacggaaatccagatgtcatcaggaaacttgctgttcacaggacaccttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgtaagatcccttttgaaataatggatttggaaaaaagacatgtcttaggtcgcttgattacagtcaacccaattgtcacagaaaaagacagcccagtgaacatagaagcagaacctccattcggagacagctacatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaactcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaatgtgcacacatggacagaacaatacaaattccaaccagaatccccttcaaagctggcttcagctattcagaaggctcatgaagaaggcatttgtggaattcgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtattcaccaccaacttatggctgaaattgaaagaaaggcaggatgtattttgtgactcaaaactcatgtcggcagccataaaagacaacagagccgtccacgccgatatgggttattggatagaaagcgcaatcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggtaggcttgagatggactttgatttctgcgaaggaactacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactccttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagacttggggagagtgatggtcatggtgggcgctactatgacggatgacataggcatgggcgtgacttatcttgccctattagcagccttcaaagttagaccaacttttgcagctggactactcttaagaaagctgacctccaaggaattgatgatgaccaccataggaatcgtactcctctctcagagcaccataccggagactatacttgaactaaccgacgcgttggccttggggatgatgattctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgctgacgatcaaaggcctcaatccaacagccattttcttaacaaccctctcaagaactagcaagaaaaggagctggccactgaatgaggctattatggcagtcgggatggtgagcattttagccagttctctcttaaagaatgatattcccatgacaggaccattagtggctggagggcttctcactgtgtgttacgtgctcactggaagatcggctgacttggaactggagagagctgctgacgtaagatgggaagaacaagcagagatatcaggaagtagtccaattctatcgataacaatatcggaagatggtagcatgtcgataaaaaatgaagaagaagaacaaacactgaccatactcattagaacaggactgctggtgatatcaggactttttcccgtgtcaatacctatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagccggagtttacaaggaaggaacattccacacaatgtggcatgtcacacgtggagccgtcctaatgcataaagggaagagaattgaaccatcatgggcggacgtcaagaaagacctgatatcgtatggaggaggctggaagttagaaggagaatggaaggaaggagaagaagtccaggtcctggctttagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggtctttatggcaacggtgttgtcacaaggagtggaacatatgtgagtgccatagcccagactgaaaaaagcatcgaagacaatccagagattgaagatgacatctttcgaaagaaaagattgaccatcatggacctccacccaggagcaggaaaaacaaaaagataccttccagcaatagtcagagaagccataaaacgaggcttgagaacactaatcctggcccccactagagttgtggcggctgaaatggaagaagctctcagaggacttccaataagataccaaaccccagctatcagagctgagcacaccgggcgggagattgtggatctaatgtgtcacgccacatttaccatgaggctactatcaccaattagagtgccaaactacaacctgattatcatggatgaagcccatttcacagacccagcaagcatagcagctagaggatacatttcaactcgagtagagatgggtgaagcagctgggattttcatgacagccacccctcctggaagcagagacccatttcctcagagcaatgcaccaatcatggatgaagaaagggaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaagacttttgattctgaatatatcaagactaggactaatgactgggactttgtggtcacgacagacatttcagaaatgggtgctaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaggctaagatgcttctagataacatcaacacgcctgaaggaatcattcccagcatgttcgaaccagagcgtgaaaaggtggacgccattgatggtgaataccgcttgagaggagaagcgaggaaaacttttgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctagaatctactctgatccactggcgctcaaagaattcaaggaattcgctgctggaagaaaatccctgaccctgaatctaatcacagagatgggtaggctcccaaccttcatgacccagaaagcaaggaatgcactggacaacctagcagtcctgcatacggctgaagcaggcggaagggcgtacaatcatgctcttagtgaactgccggagactctggagactctgcttttactgacacttttggccacagtcacgggcggaatcttcctgttcttgatgagcggaaaaggtatagggaagatgaccctgggaatgtgctgcataatcacggctagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagctacagtgctaatgggtcttgggaagggatggccattgtcaaaaatggacattggagttccccttctcgctatcgggtgctattcacaagtcaaccccataactctcacagcagcccttctcttattggtagcacattatgctatcatagggccaggactccaggcgaaagcaactagagaggctcagaaaagagcagcagcgggcatcatgaaaaacccaactgtggatggaataacagtgattgacctagatccaataccctatgatccaaagtttgaaaagcagttgggacaggtaatgctcttagtcctctgcgtgactcaagtattgatgatgaggactacatgggctttatgtgaagctctaaccttagcaaccgggcccatctctacactgtgggaaggaaatccagggagattttggaacacaactattgcagtgtcaatggctaacatttttagagggagttacctggccggagccggacttctcttttccatcatgaagaacacggccaacacaagaaggggaactggcaacacaggagagacgcttggagagaaatggaaaaaccggttgaatgcattagggaagagtgaattccagatctataagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcttaacaaaaggaggaccaggacacgaagaacccattcccatgtcaacatatggttggaatctggtgcgtcttcaaagtggagttgatgttttttttactccgccagaaaagtgtgacacattgctgtgtgacataggggagtcgtcaccaaaccccacggttgaagcaggacgaacactcagagttctaaacttagtggaaaattggctgaacaacaacacccaattttgcataaaggttctcaacccatacatgccctcagttatagaaaaaatggaagcgctacaaaggaaatacggaggagctttggtgaggaatccactctcacgaaattccacacatgagatgtactgggtatctaatgcttccgggaacatagtgtcatcagtgaacatgatttcaagaatgttgattaacagattcacaatgagacacaagaaggccacgtacgagccagatgttgacctcggaagtggaacccgcaacataggaattgaaagtgagacaccaaatttagacataattgggaaaagaatagaaaaaataaagcaagagcatgaaacatcatggcactatgaccaagaccacccatacaaaacgtgggcctaccatggtagctacgaaacaaaacagactggatcagcatcatccatggtgaacggagtggttaggctgctaacaaaaccttgggacatcatccctatggtgacacagatggcaatgacagatacgactccatttggacaacagcgcgtcttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccctaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagaaaagaagctaggggagtttggcaaagcaaaaggcagcagagccatatggtacatgtggcttggagcacgcttcttagaatttgaagccctaggattcctgaatgaagatcactggttttccagagagaactccctgagtggagtggaaggagaagggctgcacaaactaggctacattttaagagacgtgagtaagaaagagggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaacatggaagcccaactgatcagacaaatggagggagaaggagtcttcaaaagtatccagcaattgacagtcacagaagaaattgcagtgaaaaactggttagtaagagtggggcgtgagaggttatcaagaatggccatcagtggagatgattgtgttgtgaaacccttagatgacaggtttgcaagcgccctaacagctctaaatgacatgggaaaggttaggaaagacatacaacaatgggaaccttcaagaggatggaacgattggacacaagtgcccttttgttcacaccattttcatgagttaatcatgaaggacggtcgtgtactcgtagtcccatgcagaaaccaagatgaactgattggtagggcccgaatttcccagggagccggatggtccctgcgggaaacagcctgtttggggaagtcttacgcccaaatgtggagcctgatgtacttccacagacgtgaccttaggctggcggcaaatgccatttgctcggcagtcccatcacactgggttccaacaagtcgaacaacctggtccatacacgccacacatgagtggatgacaacagaagacatgctgacagtctggaacagggtgtggattcaagaaaacccatggatggaagacaaaactctagtagaatcatgggaagaaatcccatatttggggaaaagagaagaccaatggtgcggctcattgattgggctaacaagcagggccacctgggcgaagaacatccaaacagcgataaatcaagttagatccctaataggcaatgaggaatacacagactacatgccatccatgaaaagattcagaagagaagaggaagaggcaggagtcttgtggtag

SEQ ID NO: 7076 - RNA, 9876 nt, synthetic construct
  misc_feature 1..9876: note = derived and/or modified CDS sequence (wt) from DENV-2__JN851130__SS-prME
  source 1..9876: mol_type = other RNA
actgcaggtataattattatgatgattccaacagtgatggcgttccatttaaccacacgcaacggagaaccacacatgatcgtcagtagacaagagaaagggaaaagtcttctgtttaaaacagagaacggtgtgaacatgtgtactctcatggccatggaccttggtgaactgtgtgaagacacaatcacttataattgtcctctcctcaggcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacatccaggcttcaccataatggcagcaatcctggcttacactataggaacgacatatttccaaagagtcctgatcttcatcttactgacagctgtcgctccttcaatgacaatgcgttgcataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaattgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggtactgttacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcaaagaaacaggatgttgtcgttttaggatcccaagaaggggctatgcacacagcactcacaggggccacggaaatccagatgtcatcaggaaacttactgttcactggacatcttaagtgcaggctgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgtaagatcccttttgaaataatggatttggaaaaaagacatgtcctaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacttcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcctcagctatccagaaggctcatgaagaaggcatttgtggaatccgctcagtaacaagactggagaatctgatgtggaaacaaataacaccagaactgaatcacattctatcagaaaatgaggtgaagttgactatcatgacaggagacattaaaggaatcatgcaggcaggaaaacgatccctgcggcctcaacccactgagctgaagtactcttggaaaacatggggcaaagcgaaaatgctctccacagagcttcacaaccacacctttctcattgatggccccgaaacagcagaatgtcccaacacaaacagagcttggaactcactagaagtcgaagactatggctttggagtattcaccaccaacatatggctgaaattgaaagaaaggcaggatgtattttgtgactcaaaactcatgtcagcagccataaaagataacagagccgtccacgccgatatgggttattggatagaaagcgcactcaatgacacatggaagattgagaaagcctcttttattgaagttaaaagctgctactggccaaagtcacacaccctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaaccacagtggtggtgactgaggactgtggaaatagaggaccctctttaagaacaactactgcttctggaaaactcataacagagtggtgctgccgatcttgcacattaccaccactaaggtacagaggtgaggatggatgctggtatggaatggaaattagaccactgaaagagaaagaagagaacttggtcaactctttggtcacagccggacatggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggattactcttaagaaagctgacctccaaggaattgatgatgaccaccataggaatcgtgctcctctcccagagcaccataccagagactatacttgaactgactgacgcattggctttggggatgatggctctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggccttaatccaacagccattttcttaacaaccctctcaagaactagcaagaaaaggagctggccactaaatgaggctattatggcagtcgggatggtgagcattttagccagttctctcttaaagaacgatattcccatgacaggaccattagtggctggagggcttctcactgtgtgttacgtactcactggaagatcggctgatttggaactggagagagctgctgacgtaagatgggaagaacaggcagagatatcaggaagtagtccaattctgtcgataacaatatcggaagatggtagcatgtcgataaaaaatgaagaagaagaacaaacactgaccatactcatcagaacaggactgttagtgatatcaggactttttcccgtgtcaataccaatcacggcagctgcatggtacctgtgggaagtgaaaaaacaacgagcaggagtattgtgggatgtcccctcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaagaaggagaagaagtccaggtcctggcattagagcctggaaagaatccaagagctgtccaaacaaaacccggtctttttaaaactaacactggaaccataggcgccgtgtctctggacttttctcctggaacgtcaggatctccaatcgtcgacaaaaaaggaaaagttgtgggcctttatggcaacggtgtcgttacaaggagtggaacatatgtgagtgctatagcccagactgaaaaaagcatcgaagacaatccagagattgaagatgacatctttcgaaagaaaagattgaccatcatggacctccacccaggagcagggaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagtagagatccatttcctcagagcaatgcaccaatcatggatgaagaaagggaaatccctgagcgttcgtggaactctggacatgaatgggttacggattttaaagggaagactgtttggtttgttccaagcataaaagcagggaatgatatagcagcttgcctgagaaagaatggaaagaaagtgatacaactcagcaggaagacttttgattctgaatatattaagactaggaccaatgattgggactttgtggtcacgacagacatttcagaaatgggtgcaaacttcaaggctgagagggttatagaccccagacgctgtatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaaaatgcttctagacaacatcaacacgcctgaaggaatcattcccagcatgttcgaaccagagcgtgaaaaggtggatgccattgatggtgaataccgcttgagaggagaagcaagaaaaacttttgtggacctaatgagaagaggagacctaccagtctggttagcctacagagtggcagctgaaggtatcaactacgcagacagaagatggtgctttgatggagtcaagaacaaccaaatcttggaagaaaatgtggaagtggaaatttggacaaaagaaggagaaaggaagaaattgaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaaccatgctcttagtgaactgccggagactctggagacattgcttttactgacactcttggccacagtcacgggcggaatcttcctgttcttgatgagtggaaagggtatagggaagatgaccctgggaatgtgctgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaatgagatgggtttcctggaaaaaacaaagaaagatttcggattgggaagcattacaacccagcaacctgagagcaatatcctggacatagatctacgtcctgcatcagcttggactctatatgccgtggcaacaactttcatcacaccaatgctgagacatagcattgaaaattcctcagtgaatgtgtctctaacagccattgccaaccaagccacagtgttaatgggtcttgggaaaggatggccattgtcaaaaatggacatcggagttccccttctcgctatcgggtgctattcacaagtcaaccccataactctcacagcagcccttctcttattggtagcacattatgctatcatagggccaggactccaagcgaaagcaactagagaggctcaaaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccaggaagattctggaatacaactattgcagtgtcaatggctaacatttttagagggagttacttggccggagccggacttctcttttctatcatgaagaacacggctaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgtttttttcactccgccagaaaagtgtgatacattgctgtgtgacataggggagtcgtcaccaaaccccacggttgaagcaggacgaacactcagagttctaaacttagtggaaaattggctgaacaacaacacccaattttgcataaaggttctcaacccatatatgccctcagttatagaaaaaatggaagcactacaaaggaaatacggaggagctttggtgaggaatccactctcacgaaattccacacacgagatgtactgggtatccaatgcttccgggaacatagtgtcatcagtgaatatgatttcaagaatgttgattaacagattcacaatgagacacaagaaggccacatacgagccagatgttgacctcggaagtggaacccgcaacatcggaattgaaagtgagataccaaatttagacataattgggaaaagaatagaaaaaataaaacaagagcatgaaacatcatggcattatgaccaagatcacccatacaaaacgtgggcctatcatggcagctacgaaacaaaacagactggatcagcatcatccatggtgaacggagtggttaggttgctaacaaaaccttgggacgttatccctatggtgacacagatggcaatgacagatacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagtaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagctatatggtacatgtggcttggagcacgcttcttagagtttgaagccctaggattcttgaacgaagatcactggttttccagagagaactccctgagtggagtggaaggagaagggctgcacaaactaggctacattttaagagacgtgagtaagaaagaaggaggagcaatgtacgctgatgacaccgcaggatgggacacaagaatcacattagaggacttaaaaaatgaagaaatggtgacaaaccacatggaaggagaacacaagaaacttgctgaagccatcttcaaattaacgtaccaaaacaaggtggtgcgtgtgcaaagaccaacgccaagaggcacagtaatggacattatatcgagaagagaccaaagaggtagcggacaagttgtcacctacggcctcaatactttcaccaacatggaagcccaactgatcagacagatggagggagaaggagtcttcaaaagcatccagcaattgacagtcacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcctttttgttcacaccatttccatgagttaatcatgaaggacggtcgtgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcagcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 7077 - RNA, 9876 nt, synthetic construct
  misc_feature 1..9876: note = derived and/or modified CDS sequence (wt) from DENV-2__JN851125__SS-prME
  source 1..9876: mol_type = other RNA
accgcaggtataattattatgatgattccaacagtgatggcgttccatttaaccacacgcaacggagaaccacacatgatcgtcagtagacaagagaaaggaaaaagtcttctgtttaaaacagagaacggtgtgaacatgtgcaccctcatggccatggaccttggtgaactgtgtgaagacacaatcacttataattgtcctcttctcaagcagaatgaaccagaagacatagactgttggtgcaactctacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacacgcccagagaattgaaacttgggtcttgagacatccaggcttcaccgtaatggcagcaatcctggcatacaccataggaacgacatatttccaaagagtcctgattttcatcttgctgacagctgtcgctccttcaatgacaatgcgttgtataggaatatcaaatagagactttgtggaaggggtttcaggaggaagctgggttgacatagtcttggaacatggaagctgtgtgacgacgatggcgaagaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggcatcgtgacctgtgcaatgttcacatgtaaaaagaacatggaaggaaaagtcgtgcaaccagaaaatttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggtctcgacttcaatgagatggtgttgctgcaaatggaaaacaaagcttggctggtgcacaggcaatggttcttagacctgccgttaccatggctgcccggagcagacacacaaggatcaaactggatacagaaggagacattggtcactttcaaaaatccccatgcaaagaaacaggatgttgttgttttaggatcccaagaaggggctatgcatacagcactcacaggggccacggaaatccagatgtcgtcaggaaacttactgttcacaggacatcttaagtgcaggttgagaatggacaaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggacttggaaaaaagacatgtcttaggtcgcctgattacagtcaacccaattgtcacagaaaaagacagcccagtcaacatagaagcagaacctccattcggagacagctatatcattataggagtagaaccgggacaactgaagctcagctggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgtagcacctcactgtctgtgtcattagtattagtgggggtcgtgacactgtatttgggagttatggtgcaggccgatagtggttgtgttgtgagttggaaaaacaaagaactgaaatgtggcagtgggatttttattacagacaacgtgcacacatggacagaacaatacaaattccaaccagaatccccttcaaagctggcttcagctattcagaaggctcatgaagaaggcatttgtggaatccgctcagtaacaagactggagaatctgatgtggaaacaaataacaccagaactgaatcacattctatcagaaaatgaggtaaagatgactatcatgacaggagacattaaaggaattatgcaggcaggaaaacgatccctgcggcctcaacccactgagctgaagtactcttggaaagcatggggcaaagcgaaaatgctctccacagaacttcataaccacacctttctcattgatggccccgaaacagcagaatgtcccaacacaaacagagcttggaactcactagaagttgaagactatggctttggagtattcaccactaacatatggctgaaattgaaagaaaggcaggatgtatcttgtgactcaaaactcatgtcagcagccataaaggacaacagagccgtccacgccgacatgggttattggatagaaagcgcactcaatgacacatggaagattgagaaagcctctttcattgaagttaaaagctgccactggccaaagtcacacaccctctggagtaatggagtgctagaaagtgagatgataattccaaagaattttgcaggaccagtatcacaacacaattatagaccaggctatcatacacaaacggcaggaccctggcatctaggtaggcttgagatggactttgatttctgcgaaggaaccacagtggtggtgactgaggactgtggaaatagaggaccctctttaagaacaaccactgcttctggaaaactcataacagagtggtgctgccgatcttgcacattaccaccactaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggacccgagtaggaacgaaacatgcaatattactagttgcagtttctttcgtgacattgatcacagggaacatgtcctttcgagatttggggagagtgatggtcatggtgggcgctaccatgacggatgacataggcatgggcgtgacttatcttgccctattagcagccttcaaagtcagaccaacttttgcagctggactactcttaagaaagctgacctccaaggaattgatgatgaccaccataggaatcgtactcctctcccagagcaccataccagagactatacttgaactgactgacgcgttggctttagggatgatggttcttaaagtagtgagaaacatggaaaagtaccaactagcagtgactatcatggccatcttgtgcgtcccaaatgcagtgatattacaaaacgcatggaaagtgagctgcacaacactggcagtggtgtccgttttcccactgcttttaacatcctcacagcagaaagcggattggataccactggcgttgacgatcaaaggcctcaatccaacagccattttcttaacaaccctctcaagaactagcaagaaaaggagctggccactaaacgaggctattatggcagtcgggatggtgagcattttagccagttctctcttaaaaaatgatattcccatgacaggaccattagtggctggagggcttctcactgtgtgttacgtgctcactggaagatcggctgatttggaactggagagagctgctgacgtaagatgggaagaacaagcagagatatcaggaagtagtccaattctgtcgataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaagtgaaaaaacaacgagcaggagtattgtgggatgtcccttcacccccacctgtgggaaaggctgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtgtctctggacttttctcctggaacgtcaggatctccaatcgtcgacaaaaaaggaaaagttgtgggcctttatggtaacggtgtcgtcacaaggagtggaacatatgtgagtgccatagcccagactgaaaaaagcatcgaagacaatccagagattgaagatgacatctttcgaaagaaaagattgaccatcatggaccttcacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggatttttatgacagctacccccccaggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcagggaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggccgagagggttatagaccccagacgctgcatgaaaccagtaatactaacagatggtgaagagcgggtaatcttggcaggacccatgccagtgacccactctagtgcagcacaaagaagagggagagtaggaagaaatccaaaaaatgaaagtgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggacgccattgatggtgaataccgcttgagaggagaagcgaggaaaactttcgtggacctaatgagaagaggagacctaccagtctggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctaggatctattctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcacacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgttgcataatcacggccagtattctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtagctgcaaccatggcaaacgagatgggtttcctggaaaaaacaaagaaagattttggattgggaagcagtacaacccagcaacatgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcaaaaatggacatcggagttccccttctcgccatcgggtgctattcacaagtcaaccccataactctcacagcagcccttctctcattggtagcacattatgccatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagctgggacaagtaatgctcttagtcctctgcgtgactcaagtgttgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttctctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacctattcccatgtcaacatacggttggaatctggtgcgtcttcaaagtggagttgatgttttttttactccgccagaaaagtgtgacacattgctgtgtgacataggggagtcatcaccaaaccccacggttgaggcaggaagaacactcagagttctaaacttagtggaaaattggctgaacaacaacacccaattttgcataaaggttctcaacccatatatgccctcagttatagaaaaaatggaagcgctacaaaggaaatacggaggagctttggtgagaaatccactctcacgaaattccacacacgagatgtactgggtatccaatgcttccgggaacatagtgtcatcagtgaacatgatttcaagaatgttaattaacagattcacaatgagacacaagaaggccacatacgagccagatgttgacctcggaagtggaactcgcaatatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccccatggtgacacagatggcaatgacagacacgactccatttggacaacagcgcgttttcaaagagaaggtggacacgagaacccaagaaccgaaagaaggcacgaaaaagctaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggagttggttgacaaggaaaggaatctccatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtacaaagaccaacaccaagaggcacagtaatggacattatatcgagaagagaccaaagaggtagtggacaagttgtcacttatggcctcaatactttcaccaacatggaagcccaactgatcagacagatggagggagaaggagtcttcaaaagcatccagcaactgacagccacagaagaaattgcagtgaaaaactggttagtaagagtggggcgtgagaggttatcaagaatggccatcagtggagatgattgtgttgtgaaacccttagatgacaggtttgcaagcgctctaacagctctaaatgacatgggaaaggttaggaaagacatacagcaatgggaaccttcaagaggatggaacgattggacacaagtgcccttttgttcacaccatttccatgagttaatcatgaaggacggtcgtgtactcgtagttccatgcagaaaccaagatgaactgattggtagggcccgaatttcccagggagccgggtggtccttgcgggaaacagcctgtttggggaagtcttacgcccaaatgtggagcctgatgtacttccacagacgcgatcttaggctggcggcaaatgccatttgctcggcagtcccatcacactgggttccaacaagtcgaacaacctggtccatacacgccacacatgagtggatgacaacagaagacatgctgacagtctggaacagggtgtggatccaagaaaacccatggatggaagacaagactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag
